United States Patent
Goddard et al.

(10) Patent No.: US 7,285,625 B2
(45) Date of Patent: Oct. 23, 2007

(54) PRO536 POLYPEPTIDES

(75) Inventors: Audrey Goddard, San Francisco, CA (US); Paul J. Godowski, Hillsborough, CA (US); Austin L. Gurney, Belmont, CA (US); Victoria Smith, Burlingame, CA (US); Colin K. Watanabe, Moraga, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 468 days.

(21) Appl. No.: 10/123,905

(22) Filed: Apr. 16, 2002

(65) Prior Publication Data

US 2003/0087344 A1 May 8, 2003

Related U.S. Application Data

(63) Continuation of application No. 10/028,072, filed on Dec. 19, 2001, now abandoned, which is a continuation of application No. PCT/US00/32678, filed on Dec. 1, 2000, which is a continuation-in-part of application No. PCT/US00/08439, filed on Mar. 30, 2000, which is a continuation-in-part of application No. 09/380,137, filed on Aug. 25, 1999, which is a continuation-in-part of application No. PCT/US99/12252, filed on Jun. 2, 1999.

(60) Provisional application No. 60/146,222, filed on Jul. 28, 1999, provisional application No. 60/090,349, filed on Jun. 23, 1998.

(51) Int. Cl.
*C07K 14/00* (2006.01)

(52) U.S. Cl. .................. 530/350; 424/192.1; 435/69.7; 530/300; 530/402

(58) Field of Classification Search .............. 536/23.5; 530/350, 351, 300; 435/69.1, 69.7
See application file for complete search history.

(56) References Cited

U.S. PATENT DOCUMENTS 6,590,075 B2 * 7/2003 Ruben et al. ............... 530/350

OTHER PUBLICATIONS

Sen, Curr. Opin. Oncol. vol. 12, pp. 82-88, 2000.*
Pennica et al., PNAS USA, vol. 95, pp. 14717-14722, 1998.*
Gygi et al. Molecular and Cellular Biology, vol. 19, pp. 1720-1730, 1999.*
Hu et al. (2003, Journal of Proteome Research 2:405-412.*
Saito-Hisaminato et al, DNA Res 2002, 9:35-45.*
Bustin et al., TRENDS in Molec. Med. 8(6): 269-272, 2002.*
Anderson et al., Electrophoresis, vol. 18, pp. 533-537, 1997.*
Kawamoto et al., Gene, 1996, vol. 174, pp. 151-158.*
Lian et al., 2001, Blood 98:513-524.*
Fessler et al., 2002, J. Biol. Chem. 277:31291-31302.*
Lucentini (2004) "Gene Association Studies are Typically Wrong", The Scientist, 18(24): 20.*
Haviv, et al. (2002) Molec. Cell. Endocrin., 191: 121-26.*
Wu (2001) J. Pathol., 195: 53-65.*
Bertucci, et al. (2000) Human Molec. Genet., 9(20): 2981-91.*
Greenbaum, et al. Genome Biology, (2003), vol. 4, Issue 9, Article 117, pp. 117.1-117.8.*
Genes VI, Benjamin Lewin, 1997, excert from chapter 29 (includes pp. 847-848).*
Database Search, DNA sequence alignments [BLASTN 2.2.1 (Jul. 12, 2001), NCBI] A1-A30.
Database Search, protein sequence alignments [BLASTN 2.2.1 (Jul. 12, 2001), NCBI] B1-B7.
Dayhoff, Accession No. P__AAB65173, WO 200073454-A1, Pub Date: Dec. 7, 2000, Ashkenazi, A. J., et al.
Dayhoff, Accession No. P__AAB94830, EP 1074617-A2, Pub Date: Feb. 7, 2001, Ota, T., et al.
Dayhoff, Accession No. P__AAU12370, WO 200140466-A2, Pub Date: Jun. 7, 2001, Baker, K. P., et al.
Dayhoff, Accession No. P__AAY50944, WO 9955721-A1, Pub Date: Nov. 4, 1999, Valenzuela, D., et al.
Dayhoff, Accession No. P__AAY66650, WO 9963088-A2, Pub Date: Dec. 9, 1999, Baker, K., et al.
Dayhoff, Accession No. P__AAY06940, WO 9916870-A1, Pub Date: Apr. 8, 1999, Sheppard, P. O.
Dayhoff, Accession No. AAH08742.1, Direct Submission, Submitted: May 25, 2001, National Institute of Health.
Dayhoff, Accession No. AAD22397.1, Direct Submission, Submitted: Jun. 15, 1998, Sheppard, P., et al.
Dayhoff, Accession No. NP__057010.1, Genome Research, vol. 13, No. 10, pp. 2265-2270, 2003, Clark H.F., et al.
Dayhoff, Accession No. P__AAW75156, WO 9839446-A2, Pub Date: Sep. 11, 1998, Ruben, S. M., et al.
Dayhoff, Accession No. P__AAB75371, WO 200100806-A2, Pub. Date: Jan. 4, 2001, Dumas Milne, E. J., et al.
Dayhoff, Accession No. P__AAB25785, WO 200037491-A2, Pub. Date: Jun. 29, 2000, Bougueleret, L., et al.
Dayhoff, Accession No. CAC25002.1, WO 0100806-A, Pub. Date: Jan. 4, 2001, Dumas Milne, E. J., et al.
GenBank, Accession No. P__AAS21442, WO 200140466-A2, Pub Date: Jun. 7, 2001, Baker, K. P., et al.
GenBank, Accession No. P__AAF44117, WO 200073454-A1, Pub Date: Dec. 7, 2000, Ashkenazi, A. J., et al.
GenBank, Accession No. P__AAZ43806, WO 9955721-A1, Pub Date: Nov. 4, 1999, Valenzuela, D., et al.

(Continued)

*Primary Examiner*—Gary B. Nickol
*Assistant Examiner*—Nirmal S. Basi
(74) *Attorney, Agent, or Firm*—Elizabeth M. Barnes; Mark T. Kresnak; Ginger R. Dreger

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

6 Claims, 550 Drawing Sheets

OTHER PUBLICATIONS

GenBank, Accession No. P_AAZ64971, WO 9963088-A2, Pub Date: Dec. 9, 1999, Baker, K., et al.
GenBank, Accession No. P_AAX34795, WO 9916870-A1, Pub Date: Apr. 8, 1999, Sheppard, P. O., et al.
GenBank, Accession No. AX080797, WO 0109327-A, Pub Date: Feb. 8, 2001, Ashkenazi, A. J., et al.
GenBank, Accession No. BC008742, Direct Submission, May 25, 2001, Akhter, N., et al.
GenBank, Accession No. AF072733, Direct Submission, Submitted: Jun. 15, 1998, Sheppard, P., et al.
GenBank, Accession No. NM_015926, Genome Research vol. 13, No. 10, pp. 2265-2270, 2003, Clark, H. F., et al.
GenBank, Accession No. P_AAH16771, EP 1074617-A2, Pub Date: Feb. 7, 2001, Ota, T., et al.
GenBank, Accession No. AK023997, Direct Submission, Submitted: Aug. 23, 2000, Isogai, T., et al.
GenBank, Accession No. BC001592, Direct Submission, Dec. 22, 2000, Strausberg, R. L., et al.
GenBank, Accession No. P_AAF64029, WO 200100806-A2, Pub Date: Jan. 4, 2001, Dumas Milne, E. J., et al.
GenBank, Accession No. P_AAA87747, WO 200037491-A2, Pub Date: Jun. 29, 2001, Bougueleret, L., et al.
GenBank, Accession No. AX061641, WO 0100806-A, Pub Date: Jan. 4, 2001, Dumas Milne, E. J., et al.
GenBank, Accession No. P_AAV34253, WO 9839446-A2, Pub Date: Sep. 11, 1998, Ruben, S. M., et al.
GenBank, Accession No. P_AAV34195, WO 9839446-A2, Pub Date: Sep. 11, 1998, Ruben, S. M., et al.
Abe, N., et al., "An Increased High-Mobility Group A2 Expression Level is Associated with malignant Phenotype in Pancreatic Exocrine Tissue," *Br J Cancer*—*89*(11):2104-9 (2003) Abstract.
Ando, M., et al., "Selective Apoptosis of Natural Killer-Cell Tumours by I-Asparaginase," *Br J Haematol.*,—130(6):860-8 (2005) Abstract.
Aust, G., et al., "Human Thyroid Carcinoma Cell Lines and Normal Thyrocytes: Expression and Regulation of Matrix Metalloproteinase Inhibitor-1 Messenger-RNA and Protein," *Thyroid*—*7*(5):713-24 (1997) Abstract.
Barnes, V.L., et al., "Expression of Embryonic Fibronectin Isoform EIIIA Parallels Alpha-Smooth Muscle Actin in Maturing and Diseased Kidney," *J Histochem Cytochem.*—*47*(6):787-98 (1999) Abstract.
Bea, S., et al., "BMI-1 Gene Amplification and Overexpression in Hematological Malignancies Occur Mainly in Mantle Cell Lymphonas," *Cancer Res.*—*61*(6):2409-12 (2001) Abstract.
Blaschke, V., et al., "Rapid Quantitation of Proinflammatory and Chemoattractant Cytokine Expression in Small Tissue Samples and Monocyte-Derived Dendritic Cells: Validation of a New Real-Time RT-PCR Technology," *J Immunol Methods.*—246(1-2):79-90 (2000) Abstract.
Buckley, A.R., et al., "Butyrate-Induced Reversal of Dexamethasone Resistance in Autonomouse Rat Nb2 Lymphoma Cells," *Apoptosis.*—*2*(6):518-28 (1997) Abstract.
Caberlotto, L. et al., "Alterations in Neuropeptide Y Levels and Y1 Binding Sites in the Flinders Sensitive Line Rats, A Genetic Animal Model of Depression," *Neurosci Lett.*—*265*(3):191-4 (1999) Abstract.
Caberlotto, L., et al., "Neurokinin 1 Receptor and Relative Abundance of the Short and Long Isoforms in the Human Brain," *Eur J Neurosci.*—*17*(9):1736-46 (2003) Abstract.
Choi, D., et al., "Characterization of Cyclin D2 Expression in Human Endometrium," *J Soc Gynecol Investig.*—*9*(1):41-6 (2002) Abstract.
Couvelard, A., et al., "Human Chorionic Gonadotrophin Beta Expression in Malignant Barrett's Oesophagus," *Virchows Arch.*—*445*(3);279-84 (2004) Abstract.
Dagenais, A., et al., "Downregulation of EnaC Activity and Expression by TNF-Alpha in Alveolar Epithelial Cells," *Am J. Physio Lung Cell Mol Physiol.*—*286*(2):L301-11 (2004) Abstract.
De Boer, C.J., et al., "Involvement of the CCNDI Gene in Hairy Cell Leukemia," *Ann Oncol.*—*7*(3):251-6 (1996) Abstract.
Debieve, F., et al., "Inhibin and Activin Production and Subunit Expression in Human Placental Cells Cultured in Vitro," *Mol Hum Reprod.*—*6*(8):743-9 (2000) Abstract.
Dong, Z., et al., "Expression of Membrane-Type Matrix Metalloproteinases 4, 5, and 6 in Mouse Corneas Infected with P. aeruginosa," *Invest Opthalmol Vis Sci*—*42*(13):3223- (2001) Abstract.
Duchrow, M., et al., "Assessment of Proliferative Activity in Colorectal Carcinomas by Quantitative Reverse Transcriptase-Polymerase Chain Reaction (RT-PCR)," *Cancer Invest.*—*19*(6): 588-96 (2001) Abstract.
Dyer, J., et al., "Molecular Characterisation of Carbohydrate Digestion and Absorption in Equine Small Intestine," *Equine Vet J.*—*34*(4):349-58 (2002) Abstract.
Egwuagu, C.E., et al., "Suppressors of Cytokine Signaling Proteins are Differentially Expressed in Th1 and Th2 Cells: Implications for Th Cell Lineage Commitment and Maintenance," *J Immunol.*—*168*(7):3181-7 (2002) Abstract.
El-Ghrably, I.A., et al., "Intravitreal Invading Cells Contribute to Vitreal Cytokine Milieu in Proliferative Vitreoretinopathy," *Br J Opthalmol.*—*85*(4):461-70 (2001) Abstract.
Eleore, L., et al., "Modulation of the Glutamatergic Receptors (AMPA and NMDA) and of Glutamate Vesicular Transporter 2 in the Rat Facial Nucleus after Axotomy," *Neuroscience*—*136*(1):147-60 (2005) Abstract.
Forsberg, H., et al., "Altered Levels of Scavenging Enzymes in Embryos Subjected to a Diabetic Environment," *Free Radic Res.*—*24*(6):451-9 (1996) Abstract.
Freyschuss, B., et al., "Induction of the Estrogen Receptor by Growth Hormone and Glucocorticoid Substitution in Priminary Cultures of Rat Hepatocytes," *Endocrinology*—*133*(4):1548-54 (1993) Abstract.
Fu, K., et al., "Cyclin D1-Negative Mantle Cell Lymphoma: A Clinocopathologic Study Based on Gene Expression Profiling," *Blood*—*106*(13):4315-21 (2005) Abstract.
Fuchs, A.R., et al., "Oxytocin Receptors in Bovine Cervix: Distrubution and Gene Expression During the Estrous Cycle," *Biol Reprod.*—*54*(3):700-8 (1996) Abstract.
Furuta, J., et al., "Silencing of the Thrombomodulin Gene in Human Malignant Melanoma," *Melanoma Res.*—*15*(1):15-20 (2005) Abstract.
Futcher, B., et al., "A Sampling of the Yeast Proteome," *Mol Cell Biol.*,—19(11):7357-68 (1999) Abstract.
George, J., et al., "Pre-translational Regulation of Cytochrome P450 Genes is Responsible for Disease-Specific Changes of Individual P450 Enzymes Among Patients with Cirrhosis," *Biochem Pharmacol.*—*49*(7):873-81 (1995) Abstract.
Giroux, M., et al., "Cyclooxygenase-2 Expression in Macrophages: Modulation by Protein Kinase C-alpha," *J immunol.*—*165*(7):3985-91 (2000) Abstract.
Gnatenko, D.V., et al., "Transcript Profiling of Human Platelets Using Microarray and Serial Analysis of Gene Expression," *Blood*—*101*(6):2285-93 (2003) Abstract.
Godbout, R., et al., "Overexpression of DEAD Box Protein (DDX1) in Neuroblastoma and Retinoblastoma Cell Lines," *J Biol Chem,*—273(33):21161-8 (1998) Abstract.
Goldenberg, R.C., et al., "Modulation of Gap Junction Mediated Intercellular Communication in TM3 Leydig Cells," *J Endocrinol.*—*177*(2):327-35 (2003) Abstract.
Golebiowski, F., et al., "Expression Level of Ubc9 Protein in Rat Tissues," *Acta Biochim Pol.*—*50*(4):1065-73 (2003) Abstract.
Grem, J.L., et al., "Thymidine Kinase, Thymidylate Synthase, and Dihydropyrimidine Dehydrogenase Profiles of Cell Lines of the National Cancer Institute's Anticancer Drug Screen," *Clin Cancer Res.*—*7*(4):999-1009 (2001) Abstract.
Grenback, E., et al., "Galanin Pituitary Adenomas," *Regul Pept,*—117(2):127-39 (2004) Abstract.
Gromova, I., et al., "Protein Abundance and mRNA Levels of the Adipocyte-Type Fatty Acid Binding Protein Correlate in Non-Invasive and Invasive Bladder Transitional Cell Carcinomas," *Int J. Oncol.*—*13*(2):379-83 (1998) Abstract.

Guo, Y., et al., "The Pathogenic Role of Macrophage Migration Inhibitory Factor in Acute Respiratory Distress Syndrome," *Zhinghua Jie He He Hu Xi Za Zhi*—25(6):337-40 (2002) Abstract.

Habu, Y., et al., "Restored Expression and Activity of Organic Ion Transporters rOAT1, rOAT3 and rOCT2 after Hyperuricemia in the Rat Kidney," *Biochem Pharmacol*—69(6):993-9 (2005) Abstract.

Hahn, M.E., et al., "Regulation of Cytochrome P4501A1 in Teleosts: Sustained Induction of CYP1A1 mRNA, Protein, and Catalytic Activity by 2,3,7,8-Tetrachlorodibenzofuran in the Marine Fish Stenotomus Chrysops," *Toxicol Appl Pharmacol.*—127(2):187-98 (1994) Abstract.

Hahnel, R., et al., "Expression of the pS2 Gene in Breast Tissues Assessed by pS2-mRNA Analysis and pS2-Protein Radioimmunoassay," *Breast Cancer Res Treat.*—24(1):71-4 (1992) Abstract.

Hamilton, L.M., et al., "The role of the Epidermal Growth Factor Receptor in Sustaining Neutrophil Inflammation in Severe Asthma," *Clin Exp Allergy.*—33(2):233-40 (2003) Abstract.

Hassett, C., et al., "Human Hepatic Microsomal Epoxide Hydrolase: Comparative Analysis of Polymorphic Expression," *Arch Biochem Biophys.*—337(2):275-83 (1997) Abstract.

Holten-Andersen, M.N., et al., "Localizatin of Tissue Inhibitor of Metalloproteinases 1 (TIMP-1) in Human Colorectal Adenoma and Adenocarcinoma," *Int J Cance,*—113(2):198-206 (2005) Abstract.

Huang, Y.H., et al., "Tissue Plasminogen Activator Induced by Dengue Virus Infection of Human Endothelial Cells," *J Med Virol.*—70(4):610-6 (2003) Abstract.

Huettner, P.C., et al., "Neu Oncogene Expression in Ovarian Tumors: A Quantitative Study," *Mod Pathol.*—5(3):250-6 (1992) Abstract.

Hui, P., et al., "Real-time Quantitative RT-PCR of Cyclin D1 mRNA in Mantle Cell Lymphoma: Comparison with FISH and Immunohistochemistry," *Leuk Lymphoma.* 44(8):1385-94 (2003) Abstract.

Husain, I., et al., "Elevation of Topoisomerase I Messenger RNA, Protein, and Catalytic Activity in Human Tumors: Demonstration of Tumor-Type Specificity and Implications for Cancer Chemotherapy," *Cancer Res.*—54(2):539-46 (1994) Abstract.

Ihmann, T., et al., "High-level mRNA Quantification of Proliferation Marker pKi-67 is Correlated with Favorable Prognosis in Colorectal Carcinoma," *J Cancer Res Clin Oncol.*—130(12):749-56 (2004) Abstract.

Ikegami, T., et al., "Modulation of Glucagon Receptor Expression and Response in Transfected Human Embryonic Kidney Cells," *Am J Physiol Cell Physiol.*—281(4):C1396-402 (2001) Abstract.

Jacquemin, E., et al., "Developmental Regulation of Acidic Fibroblast Growth Factor (aFGF) Expression in Bovine Retina," *Int J Biol.*—37(3):417-23 (1993) Abstract.

Jaime, M., et al., "The p21 (Cip1) Protein, A Cyclin Inhibitor, Regulates the Levels and the Intracellular Localization of CDC25A in Mice Regenerating Livers," *Hepatology*—35(5):1063-71 (2002) Abstract.

Janssens, N., et al., "Alteration of Frizzled Expression in renal Cell Carcinoma," *Tumour Biol.*—25(4):161-71 (2004) Abstract.

Jungbluth, A.A., et al., "Immunohistochemical Analysis of NY-ESO-1 Antigen Expression in Normal and Malignant Human Tissues," *Int J. Cancer*—92(6):856-60 (2001) Abstract.

Kalabis, G.M., et al., "Multidrug Resistance Phosphoglycoprotein (ABCB1) in the Mouse Placenta: Fetal Protection," *Biol Reprod.*—73(4):591-7 (2005) Abstract.

Kammaori, M., et al., "Expression of Human Telomerase Reverse Transcriptase Gene and Protein, and of Estrogen amd Progesterone Receptors, in Breast Tumors: Preliminary Data from Neo-Adjuvant Chemotherapy," *Int J Oncol.*—27(5):1257-63 (2005) Abstract.

Khal, J., et al., "Expression of the Ubiquitin-Proteasome Pathway and Muscle Loss in Experimental Cancer Cachexi," *Br J Cancer*—93(7):774-80 (2005), Abstract.

Khal, J., et al., "Increased Expression of Proteasome Subunits in Skeletal Muscle of Cancer Patients with Weight Loss," *Int J. Biochem Cell Biol.*—37(10):2196-206 (2005) Abstract.

Kogo, H., et al., "Cell Type-Specific Occurrence of Caveolin-1alpha and -1beta in the Lung caused by Expression of Distinct mRNAs," *J Biol Chem.*—279(24):25574-81 (2004) Abstract.

Kommoss, F., et al., "Oncogene and Growth Factor Expression in Ovarian Cancer," *Acta Obstet Gynecol Scand Suppl.*—155:19-24 (1992) Abstract.

Kumar, U., et al., "Somatostatin Receptors in Primary Human Breast Cancer: Quantitative Analysis of mRNA for Subtypes 1-5 and Correlation with Receptor Protein Expression and Tumor Pathology," *Breast Cancer Res. Treat.*—92(2):175-86 (2005) Abstract.

Kuo, C.C., et al., "A Transcriptomic and Proteomic Analysis of the Effect of CpG-ODN on Human THP-1 Monocytic Leukemia Cells," *Proteomics*—5(4):894-906 (2005) Abstract.

Landmark, B.F., et al., "Cellular Location and Age-dependent Changes of the regulatory Subunits of cAMP-dependent Protein Kinase in Rat Testis," *J Reprod Fertil.*—99(2):323-34 (1993) Abstract.

Lassmann, S., et al., "Quantification of CK20 Gene and Protein Expression in Colorectal Cancer by RT-PCR and Immunohistochemistry Reveals Inter- and Intratumour Heterogeneity," *J Pathol.*—198(2):198-206 (2002) Abstract.

Legrand, O., et al., "Expression of the Multidrug Resistance-Associated Protein (MRP) mRNA and Protein in Normal Peripheral Blood and Bone Marrow Haemopoietic Cells," *Br J, Haematol.*—94(1):23-33 (1996) Abstract.

Lemstrom, K.B., et al., "Vascular Endothelial Growth Factor Enhances Cardiac Allograft Arteriosclerosis," *Circulation*—105(21):2524-30 (2002) Abstract.

Li, Z.B., et al., "Enhanced Expressions of Arachidonic Acid-Sensitive Tandem-Pore Domain Potassium Channels in Rat Experimental Acute Cerebral Ischemia," *Biochem Biophys Res Commun.*—327(4):1163-9 (2005) Abstract.

Li, Y., et al., "Retinal Preconditioning and the Induction of Heat-Shock Protein 27," *Invest Ophthalmol Vis Sci.*—44(3):1299-304 (2003) Abstract.

Lindberg, P., et al., "Increasing Expression of Tissue Plasminogen Activator and Plasminogen Activator Inhibitor Type 2 in Dog Gingival Tissues with Progressive Inflammation," *Arch Oral Biol.*—46(1):23-31 (2001) Abstract.

Macabeo-Ong, M., et al., "Effect of Duration of Fixation on Quantitative Reverse Transcription Polymerase Chain Reaction Analyses," 15(9):979-87 (2002) Abstract.

Maruyama, H., et al., "Id-1 and Id-2 are Overexpressed In Pancreatic Cancer and in Dysplastic Lesions in Chronic Pancreatitis," *Am J Pathol.*—155(3):815-22 (1999) Abstract.

Meehan, T.P., et al., "Tightly Regulated and Inducible Expression of a Yoked Hormone-Receptor Complex in HEK 293 Cells," *J Mol Endocrinol.*—32(1):247-55 (2004) Abstract.

Mendoza-Rodriguez, C.A., et al., "C-fos and Estrogen Receptor Gene Expression Pattern in the Rat Uterine Epithelium During the Estrous Cycle," *Mol Reprod Dev.* 64(4):379-88 (2003) Abstract.

Meoni, P., et al., "[3H]MK-801 Binding and the mRNA for the NMDARI Subunit of the NMDA Receptor are Differentially Distributed in Human and Rat Forebrain," *Brain Res Mol Res.*—54(1):13-23 (1998) Abstract.

Mezzano, S.A., et al., "Overexpression of Chemokines, Fibrogenic Cytokines, and Myofibroblasts in Human Membranous Nephropathy," *Kiney Int.*—57(1):147-58 (2000) Abstract.

Mingrone, G., et al., "Decreased Uncoupling Protein Expression and Intramyocytic Triglyceride Depletion in Formerly Obese Subjects," *Obes Res.*—11(5):632-40 (2003) Abstract.

Miralles, C.P., et al., "Differential Expression of the Short and Long Forms of the Gamma 2 Subunit of the GABAA/benzodiazepine Receptors," *Brain Res Mol Res.*—24 (1-4):129-39 (1994) Abstract.

Mizrachi, D., et al., "Follicle-stimulating Hormone Receptor and Its Messenger Ribonucleic Acid are Present in the Bovine Cervix and Can Regulate Cervical Prostanoid Synthesis," *Biol Reprod.*—61(3):776-84 (1999) Abstract.

Monaghan, P., et al., "The Alpha(v)beta6 Integrin Receptor for Foot-and-Mouth Disease Virus is Expressed Constitutively on the Epithelial Cells Targeted in Cattle," *J Gen Virol.*—86(Pt 10):2769-80 (2005) Abstract.

Montuori, N., et al., "Urokinase-Mediated Posttranscriptional Regualtion of Urokinase-Receptor Expression in Non Small Cell Lung Carcinoma," *Int J Cancer*—105(3):353-60 (2003) Abstract.

Munaut, C., et al., "Vascular Endothelial Growth Factor Expression Correlates with Matrix Metalloproteinases MT1-MMP, MMP-2 and MMP-9 in Human Glioblastomas," *Int J Cancer—106*(6):848-55 (2003) Abstract.

Nie, Y., et al., "DNA Hypermethylation is a Mechanism for Loss of Expression of the HLA Class I Genes in Human Esophageal Squamous Cell Carcinomas," *Carcinogenesis—22*(10):1615-23 (2001) Abstract.

Nuciforo, P.G., et al., "Molecular and Immunohistochemical Analysis of HER2/neu Oncogene in Synovial Sarcoma," *Hum Pathol.—34*(7):639-45 (2003) Abstract.

Oberringer, M., et al., "Differential Expression of Heat Shock Protein 70 in Well Healing and Chronic Human Wound Tissue," *Biochem Biophys Res Commun.—214*(3):1009-14 (1995) Abstract.

Orntoft, T.F., et al., "Genome-wide Study of Gene Copy Numbers, Transcripts, and Proteins Levels in Pairs of Non-invasive and Invasive Human Transitional Cell Carcincomas," *Mol Cell Proteomics.—1*(1):37-45 (2002) Abstract.

Orntoft, T.F., et al. "Genome-Wide Study of Gene Copy Numbers, Transcripts, and Protein Levels in Pairs of Non-Invasive and Invasive Human Transitional Cell Carcinomas," *Molecular & Cellular Proteomics—1*:37-45 (2002).

Pachmann, K., et al., "Expression of bcr-abl mRNA in Individual Chronic Myelogenous Leukaemia Cells as determined by in Situ Amplification," *Br J. Haematol—112*(3):749-59 (2001) Abstract.

Pairon, J.C., et al., "Cell Localization and Regulation of Expression of Cytochrome P450 1A1 and 2B1 in Rat Lung after Induction with 3-Methylcholanthrene Using mRNA Hybridization and Immunohistochemistry," *Am J Respir Cell Mol Biol.—11*(4):386-96 (1994) Abstract.

Papotti, M., et al., "Correlative Immunohistochemical and Reverse Transcriptase Polymerase Chain Reaction Analysis of Somatostatin Receptor Type 2 in Neuroendocrine Tumors of the Lung," *Diagn Mol Pathol.—9*(1):47-57 (2000) Abstract.

Papotti, M., et al., "Expression of Somatostatin Receptor Types 1-5 in 81 Cases if Gastrointestinal and Pancreatic Endocrine Tumors. A correlative Immunohistochemical and Reverse-Transcriptase Polymerase Chain Reaction Analysis," *Virchows Arch.—440*(5):461-75 (2002) Abstract.

Paredes, J., et al., "P-Cadherin Overexpression is an Indicator of Clinical Outcome in Invasive Breast Carcinomas and is Associated with CDH3 Promoter Hypomethylation," *Clin Cancer Res.—11*(16):5869-77 (2005) Abstract.

Politis, I., et al., "Mammary-Derived Growth Inhibitor Protein and Messenger Ribonucleic Acid Concentrations in Different Physiological States of the Gland," *J Dairy Sci.—75*(6):1423-9 (1992) Abstract.

Preesman, A.H., et al., "T-Cell Receptor V Beta-family Usage in Primary Cutaneous and Primary Nodal T-cell non-Hodgkin's Lymphomas," *J Invest Dermatol.—99*(5):587-93 (1992) Abstract.

Pullig, O., et al., "Matrilin-3 in Human Articular Cartilage: Increased Expression in Osteoarthritis," *Osteoarthritis Cartilage—10*(4):253-63 (2002) Abstract.

Rey, C., et al., "Up-regulation of Mitochondrial Peripheral Benzodiazepine Receptor Expression by Tumor Necrosis Factor Alpha in Testicular Leydig Clels. Possible Involvement in Cell Survival," *Biochem Pharmacol.—60*(11):1636-46 (2000) Abstract.

Rudlowski, C., et al., "GLUT1 Messenger RNA and Protein Induction Rrelates to the Malignant Transformation of Cervical Cancer," *Am J. Clin Pathol.—120*(5):691-8 (2003) Abstract.

Sasaki, T., et al., "Expression and Distribution of Laminin Alpha1 and Alpha2 Chains in Embryonic and Adult Mouse Tissues: An Immunochemical Approach," *Exp Cell Res.—275*(2):189-99 (2002) Abstract.

Sedelies, K.A., et al., "Discordant Regulation of Granzyme H and Granzyme B Expression in Human Lymphocytes," *J Biol Chem.—279*(25):26581-7 (2004) Abstract.

Shen, Y., et al., "BLC2 Protein Expression Parallels its mRNA level in normal and Maligent B Cells," *Blood—104*(9):2936-9 (2004) Abstract.

Shinohara, Y., et al., "Quantitative Determinations of the Steady Transcript Levels of Hexokinase Isozymes and Glucose Transporter Isoforms in Normal Rat Tissues and the Malignant Tumor Cell Line AH130," *Biochim Biophys Acta—1368*(1):129-36 (1998) Abstract.

Silvers, A.L., et al., "UVA Irradiation-Induced Activation of Activator Protein-1 is Correlated with Induced Expression of AP-1 Family Memebers in the Human Keratinocyte Cell Line HaCat," *Photochem Photobiol.—75*(3):302-10 (2002) Abstract.

Song, L., et al., "Rat Kidney Glutamyl Aminopeptidase (aminopeptidase A): Molecular Identity and Cellular Localization," *Am J. Physiol.—267*(4 Pt 2):F546-57 (1994) Abstract.

Spaziani, E.P., et al., "Tumor Necrosis Factor-Alpha Upregulates the Prostaglandin E2 EP1 Receptor Subtype and the Cyclooxgenase-2 Isoform in Cultured Amnion WISH Cells," *J Interferon Cytokine Res.—18*(12):1039-44 (1998) Abstract.

Spika, I., et al., "Transcriptional Activity of Potent Glucocorticoids: Relevance of Glucocorticord Receptor Isoforms and Drug Metabolites," *Skin Pharmacol Appl Skin Physiol.—16*(3):143-50 (2003) Abstract.

Splinter, P.L., et al., "Specific Inhibition of AQP1 Water Channels in Isolated Rat Intrahepatic Bile Duct Units by Small Interfering RNAs," *J Biol Chem—278*(8):6268-74 (2003) Abstract.

Stearns, M.E., et al., "Type IV Collagenase (M(r) 72,000) Expression in Human Prostate: Benign and Malignant Tissue," *Cancer Res.—53*(4):878-83 (1993) Abstract.

Stein, R., et al., "The Decompensated Detrusor III: Impact of Bladder Outlet Obstruction on Sarcoplasmic Endoplasmic Reticulum Protein and Gene Expression," *J Urol.—164*(3Pt2):1026-30 (2000) Abstract.

Strickland, I., et al., "TNF-Alpha and IL-8 are Upregulated in the Epidermis of Normal Human Skin after UVB Exposure: Correlation with Nuetrophil Accumulation and E-Selectin Expression," *J Invest Dermatol.—108*(5):763-8 (1997) Abstract.

Strutz, F., et al., "Basic Fibroblast Growth Factor Expression is Increased in Human Renal Fibrogenesis and May Mediate Acutocrine Fibroblast Proliferation," *Kidney Int.—57*(4):1521-38 (2000) Abstract.

Takahashi, K., et al., "Adiposity Elevates Plasma MCP-1 Levels Leading to the Increased CD11b-Positive Monocytes in Mice," *J Biol. Chem.—278*(47):46654-60 (2003) Abstract.

Takimoto, Y., et al., "Augmented Expression of Neuronal Nitric Oxide Synthase in the Atria Parasympthetically Decreases Heart Rate During Acute Myocardial Infarction in Rats," *Circulation—105*(4):490-6 (2002) Abstract.

Telek, G., et al., "Differential Upregulation of Cellular Adhesion Molecules at the Sites of Oxidative Stress in Experimental Acute Pancreatitis," *J Surg Res.—96*(1):56-67 (2001) Abstract.

Timchenko, L., et al., "Myotonic Dystrophy: An Unstable CTG Repeat in a Protein Kinase Gene," *Semin Cell Biol.—6*(1):13-9 (1995) Abstract.

Torronen, R., et al., "Induction of Class 3 Aldehyde Dehydrogenase in the Mouse Hepatoma Cell Line Hepa-1 by Various Chemicals," *Chem Biol. Interact.—83*(2):107-19 (1992) Abstract.

Ullmannova, V., et al., "Relationship Between Cyclin D1 and p21 (Waf1/Cip1) During Differentiation of Human Myeloid Leukemia Cell Lines," *Leuk Res.—27*(12):1115-23 (2003) Abstract.

Van Beers, E.H., et al., "Intestinal Carbamoyl Phosphate Synthase I in Human and Rat. Expression during Development Shows Species Differences and Mosaic Expression in Duodenum of Both Species," *J Histochem Cytochem.—46*(2):231-40 (1998) Abstract.

Van Der Wilt, C.L., et al., "Expression of Deoxycytidine Kinase in Leukaemic Cells Compared with Solid Tumour Cell Lines, Liver Metastases and Normal Liver," *Eur J Cancer—39*(5):691-7 (2003) Abstract.

Waldherr, R., et al., "Expression of Cytokines and Growth Factors in Human Glomerulonephritides," *Pediatr Nephrol.—7*(4):471-8 (1993) Abstract.

Walmer, D.K., et al., "Malignant Transformation of the Human Endometrium is associated with Overexpression of Lactoferrin Messenger RNA and Protein," *Cancer Res.—55*(5):1168-75 (1995) Abstract.

Wang, J., et al., "Cell Proliferation in Human Soft Tissue Tumors Correlates with Platelet-derived Growth Factor B Chain Expression: An Immunohistochemical and in Situ Hybridization Study," *Cancer Res.—54*(2):560-4 (1994) Abstract.

Wang, J., et al., "Expression of Cadherins and Catenins in Paired Tumor and Non-neoplastic Primary Prostate Cultures and Corresponding Prostatectomy Specimens," *Urol Res.—28*(5):308-15 (2000) Abstract.

Wang, L.G., et al., "Down-Regulation of Prostate-Specific Antigen Expression by Finasteride through Inhibition of Complex Formation Between Androgen Receptor and Steroid Receptor-binding Consensus in the Promoter of the PSA Gene in LNCaP Cells," *Cancer Res.—57*(4):714-9 (1997) Abstract.

Weterman, M.A., et al., "Expression of Calcyclin in Human Melanocytic Lesions," *Cancer Res.—53*(24):6061-6 (1993) Abstract.

Williams, E.T., et al., "Estrogen Regulation of the Cytochrome P450 3A Subfamily in Humans," J Pharmacol Exp Ther. 311(2):728-35 (2004) Abstract.

Wojtaszek, P.A., et al., "Severely Decreased MARCKS Expression Correlates with Ras Reversion but not with Mitogenic Responsiveness" *Oncogene—8*(3):755-60 (1993) Abstract.

Zhong, W., et al., "Expression of Superoxide Dismutases, Catalase, and Glutathione Peroxidase in Glioma Cells," *Free Radic Biol Med.—27*(11-12):1334-45 (1999) Abstract.

Xi, L., et al., "Expression of Human Telomerase Reverse Transcriptase in Cervix Cancer and its Significance," Zhonghua Fu Chan Ke Za Zhi—40(6):407-10 (2005) Abstract.

Alberts, B., et al., Molecular Biology of the Cell (3$^{rd}$ ed. 1994) Cell 3$^{rd}$ at 453 Figure 9-2 of Cell 3$^{rd}$ Cell 3$^{rd}$ at 403.

Alberts, B., et al., Molecular Biology of the Cell (4$^{th}$ ed.) In Cell 4$^{th}$, Figure 6-3 on p. 302 Figure 6-90 on p. 364 of Cell 4$^{th}$ Cell 4$^{th}$ at 364 Cell 4$^{th}$ at 379.

Aust, G., et al., "Human Throid Carcinoma Cell Lines and Normal Thyrocytes: Expression and Regulation of Matrix Metalloproteinase-1 and Tissued Matrix Metalloproteinase Inhibitor-Messenger-RNA and Protein," *Thyroid -7*(5):713-724 (1997).

Beà, S., et al., "BMI-1 Gene Amplification and Overexpression in Hematological Malignancies Occur Mainly in Mantle Cell Lymphomas," *Cancer Research—61*:2409-2412 (2001).

Beer, et al., "Gene-expression profiles predict survival of patients with lung adenocarcinoma," *Nature Biomedicine—98*(6):816-824 (2002).

Futcher, B., et al., "A Sampling of the Yeast Proteome," *Molecular and Cellular Biology—19*(11):7357-7368 (1999).

Golub, T.R., et al., "Molecular Classification of Cancer: Cass Discovery and Class Prediction by Gene Expression Monitoring," *Science—286*:531-537 (1999).

Gnatenko, D.V., et al., "Transcript Profiling of Human Platelets Using Microarray and Serial Analysis of Gene Expression," *Blood—101*(6):2285-2293 (2003).

Greenbaum, D., et al., "Analysis of mRNA Expression and Protein Abundance Data: An Approach for the Comparison of the Enrichment of Features in the Cellular Population of Proteins and Transcripts," *Bioinformaticsl—18*(4):585-496 (2002).

Gromova, I., et al., "Protein Abundancy and mRNA Levels of the Adipocyte-Type Fatty Acid Binding Protein Correlate in Non-Invasive and Invasive Bladder Transitional Cell Carcinomas," *International Journal of Oncology—13*(2) 6 pages (1998).

Hähnel, E., et al., "Expression of the pS2 Gene in Breast Tissues Assessed by pS2-mRNA Analysis and pS2-Protein Radioimmunoassay," *Breast Cancer Research and Treatment—24*:71-74 (1992).

Hirsch, F.R., et al., "Early Detection of Lung Cancer: Clinical Perspectives of Recent Advances in Biology and Radiology," *Clinical Cancer Research—7*:5-22 (2001).

Holten-Andersen, M.D., et al., "Localization of Tissue Inhibitor of Metalloproteinases 1 (TIMP-1) in Human Colorectal Adenoma and Adenocarcinoma," *Int. J. Cancerl—113*:198-206 (2005).

Janssens, N., et al., "Alteration of Frizzled Expression in Renal Cell Carcinoma," *Tumor Biology—25*:161-171 (2004).

Kammori, M., et al., "Expression of Human Telomerase Reverse Transcriptase Gene and Protein, and of Estrogen and Progesterone Receptors, in Breast Tumors: Preliminary Data from Neo-Adjuvant Chemotherapy", International *Journal of Oncology—27*(5) (2005).

Kuo, C.C., et al., "A Transcriptomic and Proteomic Analysis of the Effect of CpG-ODN on Human THP-1 Monocytic Leukemia Cells," *Proteomics—5*:894-906 (2005).

Lewin, B., Genes VI (1997 *Genes VI* at 847-848.

Meric, F., et al., "Translation Initiation in Cancer: A Novel Target for Therapy," *Molecular Cancer Therapeutics—1*:971-979 (2002).

Munaut, C., et al., "Vascular Endothelial Growth Factor Expression Correlates With Matrix Metalloproteinases MT1-NMP, MNP-2 and NMP-9 in Human Glioblastomas," *Int. J. Cancer—106*:848-855 (2003).

Maruyama, H., et al., "Id-1 and Id-2 are Overexpressed in Pancreatic Cancer and in Dysplastic Lesions in Chronic Pancreatitis," *American Journal of Pathology—155*(3):815-822 (1999).

Nuciforo, P. G., et al., "Molecular and Immunohistochemical Analysis of HER2/neu Oncogene in Synovial Sarcoma," *Human Pathology—34*(7):639-645 (2003).

Papotti, M., et al., "Correlative Immunohistochemical and Reverse Transcriptase Polymerase Chain Reaction Analysis of Somatostatin Receptor Type 2 in Neuroendocrine Tumors of the Lung," *Diagnostic Molecular Pathology—9*(1):47-57 (2000).

Walmer, D. K., et al., "Malignant Transformation of the Human Endometrium is Associated with Overexpression of Lactoferrin Messenger RNA and Protein," *Cancer Research—55*(5):1168-1174 (1995).

Wang, J., et al., "Expression of Cadherins and Catenins in Paired Tumor and non-Neoplastic Primary Prostate Cultures and Corresponding Prostatectomy Specimens," *Urol Resl—28*:308-315 (2000).

Wen-Hsiang, W., et al., "Comparision of *TP53* Mutations Identified by Oligonucleotide Microarray and Conventional DNA Sequence Analysis," *Cancer Research—60*:2716-2722 (2000).

Zhigang, Z., et al., "Prostate Stem Cell Antigen (PSCA) Express in Human Prostate Cancer Tissues and its Potential Role in Prostate Carinogenesis and Progession of Prostate Cancer," *World Journal of Surgical Oncology—2*-13 (2004).

* cited by examiner

FIGURE 1

GTTACTCGGTGGTGGCGGAGTCTACGGAAGCCGTTTTCGCTTCACTTTTCCTGGCTGTAGAG
CGCTTTCCCCCTGGCGGGTGAGAGTGCAGAGACGAAGGTGCGAG<u>ATG</u>AGCACTATGTTCGCG
GACACTCTCCTCATCGTTTTTATCTCTGTGTGCACGGCTCTGCTCGCAGAGGGCATAACCTG
GGTCCTGGTTTACAGGACAGACAAGTACAAGAGACTGAAGGCAGAAGTGGAAAAACAGAGTA
AAAAATTGGAAAAGAAGAAGGAAACAATAACAGAGTCAGCTGGTCGACAACAGAAAAGAAA
ATAGAGAGACAAGAAGAGAAACTGAAGAATAACAACAGAGATCTATCAATGGTTCGAATGAA
ATCCATGTTTGCTATTGGCTTTTGTTTTACTGCCCTAATGGGAATGTTCAATTCCATATTTG
ATGGTAGAGTGGTGGCAAAGCTTCCTTTTACCCCTCTTTCTTACATCCAAGGACTGTCTCAT
CGAAATCTGCTGGGAGATGACACCACAGACTGTTCCTTCATTTTCCTGTATATTCTCTGTAC
TATGTCGATTCGACAGAACATTCAGAAGATTCTCGGCCTTGCCCCTTCACGAGCCGCCACCA
AGCAGGCAGGTGGATTTCTTGGCCCACCACCTCCTTCTGGGAAGTTCTCT<u>TGA</u>ACTCAAGAA
CTCTTTATTTTCTATCATTCTTTCTAGACACACACACATCAGACTGGCAACTGTTTTGTAGC
AAGAGCCATAGGTAGCCTTACTACTTGGGCCTCTTTCTAGTTTTGAATTATTTCTAAGCCTT
TTGGGTATGATTAGAGTGAAAATGGCAGCCAGCAAACTTGATAGTGCTTTTGGTCCTAGATG
ATTTTTATCAAATAAGTGGATTGATTAGTTAAGTTCAGGTAATGTTTATGTAATGAAAAACA
AATAGCATCCTTCTTGTTTCATTTACATAAGTATTTTCTGTGGGACCGACTCTCAAGGCACT
GTGTATGCCCTGCAAGTTGGCTGTCTATGAGCATTTAGAGATTTAGAAGAAAAATTTAGTTT
GTTTAACCCTTGTAACTGTTTGTTTTGTTGTTGTTTTTTTTCAAGCCAAATACATGACATA
AGATCAATAAAGAGGCCAAATTTTTAGCTGTTTTATGTACAAGGAGAGATCTGTTTCATTTT
GTTTTGCCGTATTTCTAGATATAAGTTTTAGCATGGGCCAGGAAGGACTAAAATAAAAGTTT
TTAAGGTACAAAAAAAAAAAAAAA

FIGURE 2

MSTMFADTLLIVFISVCTALLAEGITWVLVYRTDKYKRLKAEVEKQSKKLEKKKETITESAG
RQQKKKIERQEEKLKNNNRDLSMVRMKSMFAIGFCFTALMGMFNSIFDGRVVAKLPFTPLSY
IQGLSHRNLLGDDTTDCSFIFLYILCTMSIRQNIQKILGLAPSRAATKQAGGFLGPPPPSGKFS

Important features:

Signal peptide:

amino acids 1-22

N-myristoylation sites.

amino acids 103-109, 163-169 cAMP- and cGMP-dependent protein kinase phosphorylation site.

amino acids 53-57

FIGURE 3

AGCCGGGGGCGGGTTTGAAGACGCGTCGTTGGGTTTTGGAGGCCGTGAAACAGCCGTTTGAG
TTTGGCTGCGGGTGGAGAACGTTTGTCAGGGGCCCGGCCAAGAAGGAGGCCCGCCTGTTACG
<u>AT</u>GGTGTCCATGAGTTTCAAGCGGAACCGCAGTGACCGGTTCTACAGCACCCGGTGCTGCGG
CTGTTGCCATGTCCGCACCGGGACGATCATCCTGGGGACCTGGTACATGGTAGTAAACCTAT
TGATGGCAATTTTGCTGACTGTGGAAGTGACTCATCCAAACTCCATGCCAGCTGTCAACATT
CAGTATGAAGTCATCGGTAATTACTATTCGTCTGAGAGAATGGCTGATAATGCCTGTGTTCT
TTTTGCCGTCTCTGTTCTTATGTTTATAATCAGTTCAATGCTGGTTTATGGAGCAATTTCTT
ATCAAGTGGGTTGGCTGATTCCATTCTTCTGTTACCGACTTTTTGACTTCGTCCTCAGTTGC
CTGGTTGCTATTAGTTCTCTCACCTATTTGCCAAGAATCAAAGAATATCTGGATCAACTACC
TGATTTTCCCTACAAAGATGACCTCCTGGCCTTGGACTCCAGCTGCCTCCTGTTCATTGTTC
TTGTGTTCTTTGCCTTATTCATCATTTTTAAGGCTTATCTAATTAACTGTGTTTGGAACTGC
TATAAATACATCAACAACCGAAACGTGCCGGAGATTGCTGTGTACCCTGCCTTTGAAAGCAC
CTCCTCAGTACGTTTTGCCAACCTATGAAATGGCCGTGAAAATGCCTGAAAAGAACCACCA
CCTCCTTACTTACCTGCCTGAAGAAATTCTGCCTTTGACAATAAATCCTATACCAGCTTTTT
GTTTGTTTATGTTACAGAATGCTGCAATTCAGGGCTCTTCAAACTTGTTTGATATAAAATAT
GTTGTCTTTTGTTTAAGCATTTATTTTCAAACACTAAGGAGCTTTTTGACATCTGTTAAACG
TCTTTTTGTTTTTTTGTTAAGTCTTTTACATTTTAATAGTTTTTGAAGACAATCTAGGTTAA
GCAAGAGCAAAGTGCCATTGTTTGCCTTTAATTGGGGGGTGGGAAGGGAAGAGGGTACTTG
CCACATAGTTTCCTTTTTAACTGCACTTTCTTTATATAATCGTTTGCATTTGTTACTTGCT
ACCCTGAGTACTTTCAGGAAGACTGACTTAAATATTCGGGGTGAGTAAGTAGTTGGGTATAA
GATCTGAACTTTTCATCTGCAGAGGCAAGAAAATATTTGACATTGTGACTTGACTGTGGAA
GATGATGGTTGCATGTTTCTAGTTTGTATATGTTTCCATCTTTGTGATAAGATGATTTAATA
AATCTCTTTAAATACTAAAAAAAAAAAAAAA

FIGURE 4

MVSMSFKRNRSDRFYSTRCCGCCHVRTGTIILGTWYMVVNLLMAILLTVEVTHPNSMPAVNI
QYEVIGNYYSSERMADNACVLFAVSVLMFIISSMLVYGAISYQVGWLIPFFCYRLFDFVLSC
LVAISSLTYLPRIKEYLDQLPDFPYKDDLLALDSSCLLFIVLVFFALFIIFKAYLINCVWNC
YKYINNRNVPEIAVYPAFESTSSVRFANL

Important features of the protein:

Transmembrane domain (Possible type II transmembrane protein):
amino acids 30-49, 81-100, 111-131, 158-175

N-glycosylation site.
amino acids 9-13

Tyrosine kinase phosphorylation sites.
amino acids 8-16, 193-202

N-myristoylation site.
amino acids 68-74

FIGURE 5

CCCGCTGGCCCGTCAGTGCTCTCCCCGTCGTTTGCCCTCTCCAGTTCCCCCAGTGCCTGCCC
TACGCACCCCGATGGCGGAGCTGCGGCCTAGCGGCGCCCCGGCCCCACCGCGCCCCGGCC
CCTGGCCCGACTGCCCCCCGGCCTTCGCTTCGCTCTTTCCCCGGGACTGCACGCCATCTA
CGGAGAGTGCCGCCGCCTTTACCCTGACCAGCCGAACCCGCTCCAGGTTACCGCTATCGTCA
AGTACTGGTTGGGTGGCCCAGACCCCTTGGACTATGTTAGCATGTACAGGAATGTGGGGAGC
CCTTCTGCTAACATCCCCGAGCACTGGCACTACATCAGCTTCGGCTGAGTGATCTCTATGG
TGACAACAGAGTCCATGAGTTTACAGGAACAGATGGACCTAGTGGTTTTGGCTTTGAGTTGA
CCTTTCGTCTGAAGAGAGAAACTGGGGAGTCTGCCCCACCAACATGGCCCGCAGAGTTAATG
CAGGGCTTGGCACGATACGTGTTCCAGTCAGAGAACACCTTCTGCAGTGGGGACCATGTGTC
CTGGCACAGCCCTTTGGATAACAGTGAGTCAAGAATTCAGCACATGCTGCTGACAGAGGACC
CACAGATGCAGCCCGTGCAGACACCCTTTGGGGTAGTTACCTTCCTCCAGATCGTTGGTGTC
TGCACTGAAGAGCTACACTCAGCCCAGCAGTGGAACGGGCAGGGCATCCTGGAGCTGCTGCG
GACAGTGCCTATTGCTGGCGGCCCTGGCTGATAACTGACATGCGGAGGGGAGAGACCATAT
TTGAGATCGATCCACACCTGCAAGAGAGAGTTGACAAAGGCATCGAGACAGATGGCTCCAAC
CTGAGTGGTGTCAGTGCCAAGTGTGCCTGGGATGACCTGAGCCGGCCCCCGAGGATGACGA
GGACAGCCGGAGCATCTGCATCGGCACACAGCCCCGGCGACTCTCTGGCAAAGACACAGAGC
AGATCCGGGAGACCCTGAGGAGAGGACTCGAGATCAACAGCAAACCTGTCCTTCCACCAATC
AACCCTCAGCGGCAGAATGGCCTCGCCCACGACCGGGCCCCGAGCCGCAAAGACAGCCTGGA
AAGTGACAGCTCCACGGCCATCATTCCCCATGAGCTGATTCGCACGCGGCAGCTTGAGAGCG
TACATCTGAAATTCAACCAGGAGTCCGGAGCCCTCATTCCTCTCTGCCTAAGGGGCAGGCTC
CTGCATGGACGGCACTTTACATATAAAAGTATCACAGGTGACATGGCCATCACGTTTGTCTC
CACGGGAGTGGAAGGCGCCTTTGCCACTGAGGAGCATCCTTACGCGGCTCATGGACCCTGGT
TACAACTCTGAACCTATCCTCGGAGCTCTGCCCTCCCGTCCTGGAACGTCTTTCTGCCCTGA
GGAGAGGGTAGTCAGCATCTCCAATTTTCAGCAGCTCAAGAACCTTGGCCCCACAGGACTT
CGCAGATGTCACATTGCCCCTCAGTCCCTGAATGCCCTTCGGACCCAACCCCAATTCCCCA
AGCCCCTGACCCCTAGCTGCCGGGGTTCCCACTCCCAGTGCCACAACCCCCTCACCTCCCC
TGGCAGCCCCTCAGCGAGCCTGAGGCCCAGCACCCGCTGGCTCCCCAGCACATGGTCCCCTC
CCATGGGCTGTTGCCCAGGGAACCGGGGCGCGGTGGGAACGAGCTGCTGGCCTCGGCATGTT
TCAATAAAGTTGCTGTGCTGGGAG

FIGURE 6

MAELRPSGAPGPTAPPAPGPTAPPAFASLFPPGLHAIYGECRRLYPDQPNPLQVTAIVKYWL
GGPDPLDYVSMYRNVGSPSANIPEHWHYISFGLSDLYGDNRVHEFTGTDGPSGFGFELTFRL
KRETGESAPPTWPAELMQGLARYVFQSENTFCSGDHVSWHSPLDNSESRIQHMLLTEDPQMQ
PVQTPFGVVTFLQIVGVCTEELHSAQQWNGQGILELLRTVPIAGGPWLITDMRRGETIFEID
PHLQERVDKGIETDGSNLSGVSAKCAWDDLSRPPEDDEDSRSICIGTQPRRLSGKDTEQIRE
TLRRGLEINSKPVLPPINPQRQNGLAHDRAPSRKDSLESDSSTAIIPHELIRTRQLESVHLK
FNQESGALIPLCLRGRLLHGRHFTYKSITGDMAITFVSTGVEGAFATEEHPYAAHGPWLQL

Important features:
N-glycosylation site.
amino acids 265-268

FIGURE 7

CGCGAATGAAGTTTGCATTTTCCTCTGTTCTTGAGCCCAGCTTCTTCTCGTCTCCCACCCCA
GCTTCCCGGCATTGGAAGAAGGGACCGTCCTCTTCCTTGTCTTGGCCACCCAAATCCTGGTA
TCGAAAGGGTTGAACGGACCGGAAGTGTGCAGCAGCGACGGGTCCCCAGCTAATCGACGCCG
GAAGTAGCAATTACTAGACAAGCATTCCGCCGCCGGCTTCGCTATGGCGGCAATTCCCCCAG
ATTCCTGGCAGCCACCCAACGTTTACTTGGAGACCAGCATGGGAATCATTGTGCTGGAGCTG
TACTGGAAGCATGCTCCAAAGACCTGTAAGAACTTTGCTGAGTTGGCTCGTCGAGGTTACTA
CAATGGCACAAAATTCCACAGAATTATCAAAGACTTCATGATCCAAGGAGGTGACCCAACAG
GGACAGGTCGAGGTGGTGCATCTATCTATGGCAAACAATTTGAAGATGAACTTCATCCAGAC
TTGAAATTCACGGGGGCTGGAATTCTCGCAATGGCCAATGCGGGCCAGATACCAATGGCAG
CCAGTTCTTTGTGACCCTCGCCCCCACCCAGTGGCTTGACGGCAAACACACCATTTTTGGCC
GAGTGTGTCAGGGCATAGGAATGGTGAATCGCGTGGGAATGGTAGAAACAAACTCCCAGGAC
CGCCCTGTGGACGACGTGAAGATCATTAAGGCATACCCTTCTGGGTAGACTTGCTACCCTCT
TGAGCAGCTCTTCTGAGATGGCCCCAGTGAACCAGCTTCTAGATGACATAGAATGACATGTA
ATGCTAAATTTCATTTTGGCTTTGCAAGTCATGAAGCTTAGGAGGCCTGGCATCTTGGGTGA
GTTAGAGATGGAAGTACATTTTAATAGGATGCTTCTTTTCTCTTCCCCCAGTGCCTAGGTTG
CCAGAGCATTTGCACAAATGCCCCTGTTTATCAATAGGTGACTACTTACTACACATGAACCA
TAATGCTGCTTCTTGTGCATGTCTGCTCTGATATACGTCGAACAATGTAGCAGCCACTGTCA
TTTCTCAGTGGTTTTGCCTAACCAAACTTCTTCCTAAGGAGATTTATATTCTGGCCTACACA
GCAGTCCTTGATGGCTGACAGCCACAGAATTCCAAACCAAGTAGTGTCTGTCAGCCCTCTTA
ACTCTGTGCACGCCCTATTTCAGTCTTTTACATTTGTTCTTCTAGGGAATGTATGCATCTCT
ATATATATTTTCCCTCTCAAAACCAGAACATCAACAGTGCTGTTTCTGACACTTCAGACATC
CCACGCAAAGCCACATTGAATTTTTGCCAAATGAAAAACACATCCAACAATCAAGTTTCTAA
GAAGGTGTCAAGTGGGGAATAATAATAATGTATAATAATCAAGAAATTAGTTTATTAAAAGG
AAGCAGAAGCATTGACCATTTTTTCCCAGAGAAGAGGAGAAATCTGTAGTGAGCAAAGGACA
GACCATGAATCCTCCTTGAGAAGTAGTACTCTCAGAAAGGAGAAGCGCCACTCAAGTTCTTT
TAACCCAAGACTTTAGAGAAATTAGGTCCAAGATTTTTATATGTTCAGTTGTTTATGTATAA
AAATAACTTTCTGGATTTTGTGGGGAGGAGCAGGAGAGGAAGGAAGTTAATACCTATGTAAT
ACATAGAAACTTCCACAATAAAATGCCATTGATGGTTAAAAAAAAAAAAAAAAAAA

FIGURE 8

MAAIPPDSWQPPNVYLETSMGIIVLELYWKHAPKTCKNFAELARRGYYNGTKFHRIIKDFMI
QGGDPTGTGRGGASIYGKQFEDELHPDLKFTGAGILAMANAGPDTNGSQFFVTLAPTQWLDG
KHTIFGRVCQGIGMVNRVGMVETNSQDRPVDDVKIIKAYPSG

Important features:

N-glycosylation sites:

amino acids 49-52, 108-111

N-myristoylation sites:

amino acids 64-69, 69-74, 143-148

Cyclophilin-type peptidyl-prolyl cis-trans isomerase signature:

amino acids 48-65

FIGURE 9

CGGACGCGTGGGCGCGCGCGAGCGCAGCGGTGGGAGGCGGCGACCAGCCGGTTGAGGCCCCA
GGCTTGGCCTCACCACAATGTGGCACGAGGCTCGGAAGCATGAGCGGAAGCTTCGAGGCATG
ATGGTCGACTACAAGAAGAGGGCGGAGCGGAGACGGGAGTATTATGAAAAGATCAAGAAGGA
CCCAGCCCAGTTCCTGCAGGTACATGGCCGAGCTTGCAAGGTGCACCTGGATTCTGCAGTCG
CCCTGGCCGCTGAGAGCCCTGTTAATATGATGCCCTGGCAGGGGACACCAACAACATGATT
GACCGATTCGATGTCCGTGCCCACCTGGACCACATCCCCGACTACACCCCCCCTCTGCTCAC
CACCATCTCCCCAGAACAGGAGTCGGACGAACGGAAGTGTAACTACGAGCGCTACAGAGGCC
TGGTGCAGAACGACTTTGCCGGCATCTCAGAGGAGCAGTGCCTGTACCAGATCTACATTGAT
GAGTTGTACGGAGGCCTCCAGAGACCCAGCGAAGATGAGAAGAAGAAGCTGGCAGAGAAGAA
GGCTTCCATCGGTTATACCTACGAGGACAGCACGGTGGCCGAGGTAGAGAAGGCGGCAGAAA
AGCCAGAGGAGGAGGAGTCAGCGGCCGAGGAGGAGAGCAACTCGGACGAAGATGAGGTCATC
CCCGACATCGACGTGGAGGTGGACGTGGATGAATTGAACCAGGAGCAGGTGGCAGATCTCAA
CAAACAGGCCACGACTTATGGCATGGCCGACGGTGACTTCGTCAGGATGCTCCGGAAAGACA
AGGAGGAGGCAGAGGCCATCAAGCATGCCAAGGCTCTTGAGGAGGAGAAGGCCATGTACTCG
GGACGCCGCTCTCGACGCCAGCGGAGAGAGTTTCGGGAGAAGCGGCTGAGGGGTCGCAAGAT
CAGCCCACCCAGCTATGCCCGCCGAGACAGCCCCACCTATGACCCCTATAAGCGGTCACCCT
CGGAGTCCAGCTCAGAGTCCCGCTCCCGCTCCCGCTCCCCGACCCCGGGCCGCGAGGAGAAG
ATCACGTTCATCACCAGTTTTGGGGGCAGCGATGAGGAGGCAGCCGCAGCCGCTGCTGCCGC
AGCAGCATCAGGAGTCACCACAGGGAAGCCCCCGCACCTCCCCAGCCTGGCGGCCCCGCCC
CGGGACGTAATGCCAGCGCCCGCCGCCGCTCCTCCTCCTCCTCCTCCTCCTCTTCTGCCTCG
AGGACCTCCAGCTCCCGCTCCAGCTCTCGCTCCAGCTCCCGCTCTCGCCGTGGTGGGGCTA
CTACCGTTCCGGCCGCCACGCCCGCTCCCGGTCCCGCTCCTGGTCCCGCTCCCGCTCCCGCT
CCCGGCGCTATTCCCGGTCCCGTAGCCGTGGCCGGCGGCACTCAGGTGGGGGCTCCCGAGAC
GGACACCGGTACTCCCGCTCGCCCGCCCGGCGTGGTGGTTACGGGCCCCGGCGCAGAAGCAG
GAGCCGCTCCCACTCAGGGGACCGCTACAGGCGGGGCGGCCGGGGCCTCAGGCACCACAGCA
GTAGCCGCAGCCGCAGCAGCTGGTCCCTCAGCCCGTCCCGCAGTCGCAGCCTGACTCGCAGC
CGCAGCCATAGCCCCAGCCCCAGCCAGAGCCGCAGCCGCAGCCGCAGCCGCAGCCAGAGCCC
CTCGCCATCACCCGCAAGAGAGAAGCTGACCAGGCCGGCCGCGTCCCCTGCTGTGGGCGAGA
AGCTGAAAAGACCGAACCTGCCGCTGGTAAAGAGACAGGAGCTGCCAAAGTCACCCAAGCT
GACGCCTCAGGAGAAGCTGAAACTGAGGATGCAGAAGGCGCTGAACAGGCAGTTCAAGGCGG
ATAAGAAGGCGGCACAAGAAAGATGATCCAGCAGGAGCATGAGCGGCAGGAGCGGGAAGAC
GAGCTTCGAGCCATGGCCCGCAAGATCCGCATGAAGGAGCGGGAACGCCGAGAGAAGGAGAG
AGAAGAGTGGGAACGCCAGTACAGCCGGCAGAGCCGCTCACCCTCCCCCCGATACAGTCGAG
AATACAGCTCTTCTCGAAGGCGCTCAAGGTCCCGATCCCGAAGCCCCCATTACCGACATTAG
GCAGAAGAGTGGGGGTGGGGAGGACAAGGGGGTGGGTAAGGGCTCAAGCTGTGATGCTGC
TGGTTTTATCTCTAGTGAAATAAAGTCAAAAGTTATTTAATTCCCGTCAAAAAAAAAAAAA
AAAAAAAAAAAAAAAAAAAAAAAAAAAAAAAAAAAAAAAA

FIGURE 10

MWHEARKHERKLRGMMVDYKKRAERRREYYEKIKKDPAQFLQVHGRACKVHLDSAVALAAES
PVNMMPWQGDTNNMIDRFDVRAHLDHIPDYTPPLLTTISPEQESDERKCNYERYRGLVQNDF
AGISEEQCLYQIYIDELYGGLQRPSEDEKKKLAEKKASIGYTYEDSTVAEVEKAAEKPEEEE
SAAEEESNSDEDEVIPDIDVEVDVDELNQEQVADLNKQATTYGMADGDFVRMLRKDKEEAEA
IKHAKALEEEKAMYSGRRSRRQRREFREKRLRGRKISPPSYARRDSPTYDPYKRSPSESSSE
SRSRSRSPTPGREEKITFITSFGGSDEEAAAAAAAAAASGVTTGKPPAPPQPGGPAPGRNAS
ARRRSSSSSSSSSASRTSSSRSSSRSSSRSRRGGGYYRSGRHARSRSRSWSRSRSRSRRYSR
SRSRGRRHSGGGSRDGHRYSRSPARRGGYGPRRRSRSRSHSGDRYRRGGRGLRHHSSSRSRS
SWSLSPSRSRSLTRSRSHSPSPSQSRSRSRSRSQSPSPSPAREKLTRPAASPAVGEKLKKTE
PAAGKETGAAKVTQADASGEAETEDAEGAEQAVQGG

Important features:
N-glycosylation site:
amino acids 370-373

Glycosaminoglycan attachment site:
amino acids 443-446 cAMP- and cGMP-dependent protein kinase phosphorylation site:
amino acids 159-162, 282-285, 291-294, 374-377, 375-378, 430-433, 440-443, 466-469

Casein kinase II phosphorylation site:
amino acids 149-152, 166-169, 171-174, 187-190, 193-196, 195-198, 303-306, 307-310, 335-338, 571-574

N-myristoylation sites:
amino acids 118-123, 229-234, 350-355, 446-451, 586-591

Amidation sites:
amino acids 263-266, 280-283, 438-441

FIGURE 11

GGTAGGCGCGCCCAGACCTGAGACGGGTTGGGACTGGGCTGCGTCACGCGCGGGCTCTAAGC
GCCCGGGGCCCCGCCCAGTGGCCGGCACAGCCAATCGCAGCGCGGGAAGGCGGTGGGGGCGG
GGAAGGCCGCCTGGAAACTTAAATCCCGAGGCGGGCGAACCTGCACCAGACCGCGGACGTCT
GTAATCTCAGAGGCTTGTTTGCTGAGGGTGCCTGCGCAGCTGCGACGGCTGCTGGTTTTGAA
ACATGAATCTTTCGCTCGTCCTGGCTGCCTTTTGCTTGGGAATAGCCTCCGCTGTTCCAAAA
TTTGACCAAAATTTGGATACAAAGTGGTACCAGTGGAAGGCAACACACAGAAGATTATATGG
CGCGAATGAAGAAGGATGGAGGAGAGCAGTGTGGGAAAAGAATATGAAAATGATTGAACTGC
ACAATGGGGAATACAGCCAAGGGAAACATGGCTTCACAATGGCCATGAATGCTTTTGGTGAC
ATGACCAATGAAGAATTCAGGCAGATGATGGGTTGCTTTCGAAACCAGAAATTCAGGAAGGG
GAAAGTGTTCCGTGAGCCTCTGTTTCTTGATCTTCCCAAATCTGTGGATTGGAGAAAGAAAG
GCTACGTGACGCCAGTGAAGAATCAGAAACAGTGTGGTTCTTGTTGGGCTTTTAGTGCGACT
GGTGCTCTTGAAGGACAGATGTTCCGGAAAACTGGGAAACTTGTCTCACTGAGCGAGCAGAA
TCTGGTGGACTGTTCGCGTCCTCAAGGCAATCAGGGCTGCAATGGTGGCTTCATGGCTAGGG
CCTTCCAGTATGTCAAGGAGAACGGAGGCCTGGACTCTGAGGAATCCTATCCATATGTAGCA
GTGGATGAAATCTGTAAGTACAGACCTGAGAATTCTGTTGCTAATGACACTGGCTTCACAGT
GGTCGCACCTGGAAAGGAGAAGGCCCTGATGAAAGCAGTCGCAACTGTGGGCCCATCTCCG
TTGCTATGGATGCAGGCCATTCGTCCTTCCAGTTCTACAAATCAGGCATTTATTTTGAACCA
GACTGCAGCAGCAAAAACCTGGATCATGGTGTTCTGGTGGTTGGCTACGGCTTTGAAGGAGC
AAATTCGAATAACAGCAAGTATTGGCTCGTCAAAAACAGCTGGGGTCCAGAATGGGGCTCGA
ATGGCTATGTAAAAATAGCCAAAGACAAGAACAACCACTGTGGAATCGCCACAGCAGCCAGC
TACCCCAATGTGTGAGCTGATGGATGGTGAGGAGGAAGGACTTAAGGACAGCATGTCTGGGG
AAATTTTATCTTGAAACTGACCAAACGCTTATTGTGTAAGATAAACCAGTTGAATCATGGAG
GATCCAAGTTGAGATTTTAATTCTGTGACATTTTTACAAGGGTAAAATGTTACCACTACTTT
AATTATTGTTATACACAGCTTTATGATATCAAAGACTCATTGCTTAATTCTAAGACTTTTGA
ATTTTCATTTTTTAAAAGATGTACAAAACAGTTTGAAATAAATTTTAATTCGTATATA

FIGURE 12

MNLSLVLAAFCLGIASAVPKFDQNLDTKWYQWKATHRRLYGANEEGWRRAVWEKNMKMIELH
NGEYSQGKHGFTMAMNAFGDMTNEEFRQMMGCFRNQKFRKGKVFREPLFLDLPKSVDWRKKG
YVTPVKNQKQCGSCWAFSATGALEGQMFRKTGKLVSLSEQNLVDCSRPQGNQGCNGGFMARA
FQYVKENGGLDSEESYPYVAVDEICKYRPENSVANDTGFTVVAPGKEKALMKAVATVGPISV
AMDAGHSSFQFYKSGIYFEPDCSSKNLDHGVLVVGYGFEGANSNNSKYWLVKNSWGPEWGSN
GYVKIAKDKNNHCGIATAASYPNV

Important features:
Signal sequence
amino acids 1-17

N-glycosylation sites.
amino acids 2-6, 221-225, 292-296

N-myristoylation sites.
amino acids 13-19, 93-99, 136-142, 145-151, 174-180, 177-183, 180-186, 194-200, 288-294, 324-330

Eukaryotic thiol (cysteine) proteases cysteine active site.
amino acids 132-144

Eukaryotic thiol (cysteine) proteases histidine active site.
amino acids 275-286

FIGURE 13

```
GGCGGCGTCATGTGATCCGCTTCCCTGCTCCTTTAAGCGTCCACAGGCGGCGGAGCGGCCAC
AATCACAGCTCCGGGCATTGGGGGAACCCGAGCCGGCTGCGCCGGGGGAATCCGTGCGGGCG
CCTTCCGTCCCGGTCCCATCCTCGCCGCGCTCCAGCACCTCTGAAGTTTTGCAGCGCCCAGA
AAGGAGGCGAGGAAGGAGGGAGTGTGTGAGAGGAGGGAGCAAAAAGCTCACCCTAAAACATT
TATTTCAAGGAGAAAAGAAAAAGGGGGGCGCAAAAATGGCTGGGGCAATTATAGAAAACAT
GAGCACCAAGAAGCTGTGCATTGTTGGTGGGATTCTGCTCGTGTTCCAAATCATCGCCTTTC
TGGTGGGAGGCTTGATTGCTCCAGGGCCCACAACGGCAGTGTCCTACATGTCGGTGAAATGT
GTGGATGCCCGTAAGAACCATCACAAGACAAAATGGTTCGTGCCTTGGGGACCCAATCATTG
TGACAAGATCCGAGACATTGAAGAGGCAATTCCAAGGGAAATTGAAGCCAATGACATCGTGT
TTTCTGTTCACATTCCCCTCCCCACATGGAGATGAGTCCTTGGTTCCAATTCATGCTGTTT
ATCCTGCAGCTGGACATTGCCTTCAAGCTAAACAACCAAATCAGAGAAAATGCAGAAGTCTC
CATGGACGTTTCCCTGGCTTACCGTGATGACGCATTTGCTGAGTGGACTGAAATGGCCCATG
AAAGAGTACCACGGAAACTCAAATGCACCTTCACATCTCCCAAGACTCCAGAGCATGAGGGC
CGTTACTATGAATGTGATGTCCTTCCTTTCATGGAAATTGGGTCTGTGGCCCATAAGTTTTA
CCTTTTAAACATCCGGCTGCCTGTGAATGAGAAGAAGAAAATCAATGTGGGAATTGGGGAGA
TAAAGGATATCCGGTTGGTGGGGATCCACCAAAATGGAGGCTTCACCAAGGTGTGGTTTGCC
ATGAAGACCTTCCTTACGCCCAGCATCTTCATCATTATGGTGTGGTATTGGAGGAGGATCAC
CATGATGTCCCGACCCCAGTGCTTCTGGAAAAGTCATCTTTGCCCTTGGGATTTCCATGA
CCTTTATCAATATCCCAGTGGAATGGTTTTCCATCGGGTTTGACTGGACCTGGATGCTGCTG
TTTGGTGACATCCGACAGGGCATCTTCTATGCGATGCTTCTGTCCTTCTGGATCATCTTCTG
TGGCGAGCACATGATGGATCAGCACGAGCGGAACCACATCGCAGGGTATTGGAAGCAAGTCG
GACCCATTGCCGTTGGCTCCTTCTGCCTCTTCATATTTGACATGTGTGAGAGAGGGGTACAA
CTCACGAATCCCTTCTACAGTATCTGGACTACAGACATTGGAACAGAGCTGGCCATGGCCTT
CATCATCGTGGCTGGAATCTGCCTCTGCCTCTACTTCCTGTTTCTATGCTTCATGGTATTTC
AGGTGTTTCGGAACATCAGTGGGAAGCAGTCCAGCCTGCCAGCTATGAGCAAAGTCCGGCGG
CTACACTATGAGGGGCTAATTTTTAGGTTCAAGTTCCTCATGCTTATCACCTTGGCCTGCGC
TGCCATGACTGTCATCTTCTTCATCGTTAGTCAGGTAACGGAAGGCCATTGGAAATGGGCG
GCGTCACAGTCCAAGTGAACAGTGCCTTTTTCACAGGCATCTATGGGATGTGGAATCTGTAT
GTCTTTGCTCTGATGTTCTTGTATGCACCATCCCATAAAAACTATGGAGAAGACCAGTCCAA
TGGCGATCTGGGTGTCCATAGTGGGGAAGAACTCCAGCTCACCACCACTATCACCCATGTGG
ACGGACCCACTGAGATCTACAAGTTGACCCGCAAGGAGGCCCAGGAGTAGGAGGCTGCAGCG
CCCGGCTGGGACGGTCTCTCCATACCCCAGCCCCTCTAACTAGAGTGGGGAGCATGCCAGAG
AGAGCTCAATGTACAAATGAATGCCTCATGGCTCTTAGCTGTGGTTTCTTGGACCAGCGGCA
TGGACATTTGTCAGTTTGCCTTCTGACGGTAGCTTTTGGAGGAAGATTCCTGCAGCCACTAA
TGCATTGTGTATGATAACAAAAACTCTGGTATGACACATTTTCTGTGATCATTGTTAATTAG
TGACATAGTAACATCTGTAGCAGCTGGTTAGTAAACCTCATGTGGGGTGGGGTGGGGGTGT
ATTCCTTGGGGGATGGTTTGGGCCGAATGGGGAGTGGAATATTTGACATTTTTCCTGTTTTA
AATTCTAGGATAGATTTTAACATCCTTTGCGGTCCCAGTCCAAGGTAGGCTGGTGTCATAGT
CTTCTCACTCCTAATCCATGACCACTGTTTTTTCCTATTTATATCACCAGGTAGCCTACTG
AGTTAATATTTAAGTTGTCAATAGATAAGTGTCCCTGTTTGTGGCATAATATAACTGAATT
TCATGAGAAGATTTATTCCACCAGGGGTATTTCAGCTTTGAAACCAAATCTGTGTATCTAAT
ACTAACCAATCTGTTGGATGTGGATTTTAAAAAATGTTTGCTAAACTACCCAAGTAAGATTT
ACTGTATTAAATGGCCTTCGGGTCTGAAAAGCTTTTTTAACCTCTTGCTTAAAATGCGTTTT
ATTTTGATAAGATACTTCAAATAGCCTCCAAAAGTGTAGATCCAATCACTTAAATAAACCTG
TATGTATATGCAAAAAAAAAAAAAAAAAAAAAAA
```

FIGURE 14

MAGAIIENMSTKKLCIVGGILLVFQIIAFLVGGLIAPGPTTAVSYMSVKCVDARKNHHKTKW
FVPWGPNHCDKIRDIEEAIPREIEANDIVFSVHIPLPHMEMSPWFQFMLFILQLDIAFKLNN
QIRENAEVSMDVSLAYRDDAFAEWTEMAHERVPRKLKCTFTSPKTPEHEGRYYECDVLPFME
IGSVAHKFYLLNIRLPVNEKKKINVGIGEIKDIRLVGIHQNGGFTKVWFAMKTFLTPSIFII
MVWYWRRITMMSRPPVLLEKVIFALGISMTFINIPVEWFSIGFDWTWMLLFGDIRQGIFYAM
LLSFWIIFCGEHMMDQHERNHIAGYWKQVGPIAVGSFCLFIFDMCERGVQLTNPFYSIWTTD
IGTELAMAFIIVAGICLCLYFLFLCFMVFQVFRNISGKQSSLPAMSKVRRLHYEGLIFRFKF
LMLITLACAAMTVIFFIVSQVTEGHWKWGGVTVQVNSAFFTGIYGMWNLYVFALMFLYAPSH
KNYGEDQSNGDLGVHSGEELQLTTTITHVDGPTEIYKLTRKEAQE

Important features of the protein:
Signal peptide:
amino acids 1-42

Transmembrane domains:
amino acids 239-253, 269-284, 302-318, 338-352, 377-399, 434-452, 471-488

N-glycosylation sites.
amino acids 8-12, 406-410 cAMP- and cGMP-dependent protein kinase phosphorylation site.
amino acids 254-258

N-myristoylation sites.
amino acids 223-229, 274-280, 305-311, 358-364, 374-380, 386-392, 509-515

FIGURE 15

```
GTGAGGGGAACAGCTGATCCGTCTGTTGGGAGGACAGATATCTCAAGGCCAGGATGGAAGAA
TCACCACTAAGCCGGGCACCATCCCGTGGTGGAGTCAACTTTCTCAATGTAGCCCGGACCTA
CATCCCCAACACCAAGGTGGAATGTCACTACACCCTTCCCCCAGGCACCATGCCCAGTGCCA
GTGACTGGATTGGCATCTTCAAGGTGGAGGCTGCCTGTGTTCGGGATTACCACACATTTGTG
TGGTCTTCCGTGCCTGAAAGTACAACTGATGGTTCCCCCATTCACACCAGTGTCCAGTTCCA
AGCCAGCTACCTGCCCAAACCAGGAGCTCAGCTCTACCAGTTCCGATATGTGAACCGCCAGG
GCCAGGTGTGTGGGCAGAGCCCCCCTTTCCAGTTCCGAGAGCCAAGGCCCATGGATGAACTG
GTGACCCTGGAGGAGGCTGATGGGGCTCTGACATCCTGCTGGTTGTCCCCAAGGCAACTGT
GTTACAGAACCAGCTCGATGAGAGCCAGCAAGAACGGAATGACCTGATGCAGCTGAAGCTAC
AGCTGGAGGGACAGGTGACAGAGCTGAGGAGCCGAGTGCAGGAGCTCGAGAGGGCTCTGGCA
ACTGCCAGGCAGGAGCACACGGAGCTGATGGAACAGTACAAGGGGATTTCCCGGTCCCATGG
GGAGATCACAGAAGAGAGGGACATCCTGAGCCGGCAACAGGGAGACCATGTGGCACGCATCC
TGGAGCTAGAGGATGACATCCAGACCATCAGTGAGAAAGTGCTGACGAAGGAAGTGGAGCTG
GACAGGCTTAGAGACACAGTGAAGGCCCTGACTCGGGAACAAGAGAAGCTCCTTGGGCAACT
GAAAGAAGTACAAGCAGACAAGGAGCAAAGTGAGGCTGAGCTCCAAGTGGCACAACAGGAGA
ACCATCACTTAAATTTGGACCTGAAGGAGGCGAAGAGCTGGCAAGAGGAGCAGAGTGCTCAG
GCTCAGCGACTGAAAGACAAGGTGGCCCAGATGAAGGACACCCTAGGCCAGGCCCAGCAGCG
GGTGGCCGAGCTGGAGCCCTTGAAGGAGCAGCTTCGAGGGCCCAGGAGCTTGCAGCCTCAA
GCCAGCAGAAAGCCACCCTTCTTGGGGAGGAGTTGGCCAGTGCAGCAGCAGCCAGGGACCGC
ACCATAGCCGAACTACACCGCAGCCGCCTGGAAGTGGCTGAAGTTAACGGCAGGCTGGCTGA
GCTCGGTTTGCACTTGAAGGAAGAAAAATGCCAATGGAGCAAGGAGCGGGCAGGGCTGCTGC
AGAGTGTGGAGGCAGAGAAGGACAAGATCCTGAAGCTGAGTGCAGAGATACTTCGATTGGAG
AAGGCAGTTCAGGAGGAGAGGACCCAAAACCAAGTGTTCAAGACTGAGCTGGCCCGGGAGAA
GGATTCTAGCCTGGTACAGTTGTCAGAAAGTAAGCGGGAGCTGACAGAGCTGCGGTCAGCCC
TGCGTGTGCTCCAGAAGGAAAAGGAGCAGTTACAGGAGGAGAAACAGGAATTGCTAGAGTAC
ATGAGAAAGCTAGAGGCCCGCCTGGAGAAGGTGGCAGATGAGAAGTGGAATGAGGATGCCAC
CACAGAGGATGAGGAGGCCGCTGTGGGGCTGAGCTGCCCGGCAGCTCTGACAGACTCAGAGG
ACGAGTCCCCAGAAGACATGAGGCTCCCACCCTATGGCCTTTGTGAGCGTGGAGACCCAGGC
TCCTCTCCTGCTGGGCCTCGAGAGGCTTCTCCCCTTGTTGTCATCAGCCAGCCGGCTCCCAT
TTCTCCTCACCTCTCTGGGCCAGCTGAGGACAGTAGCTCTGACTCGGAGGCTGAAGATGAGA
AGTCAGTCCTGATGGCAGCTGTGCAGAGTGGGGGTGAGGAGGCCAACTTACTGCTTCCTGAA
CTGGGCAGTGCCTTCTATGACATGGCCAGTGGCTTTACAGTGGGTACCCTGTCAGAAACCAG
CACTGGGGGCCCTGCCACCCCCACATGGAAGGAGTGTCCTATCTGTAAGGAGCGCTTTCCTG
CTGAGAGTGACAAGGATGCCCTGGAGGACCACATGGATGGACACTTCTTTTTCAGCACCCAG
GACCCCTTCACCTTTGAGTGATCTTACTCCCTCGTACATGCACAAATACACACTCATGCACA
CACACACTCACACACATGCATACACTTAGGTTTCATGCCCATTTTCTATCACACTGGGCTCC
ATGATATTCTGTTCCCTAAGAACTGCTTCTGTGTGCCCTGTTTTCATCCCAAGATTTCTCAC
TTCATCCTCTCCTACCTGGCTCTTTTGTCCCAGGGAGGGGTCCTGTTCGGAAGCAGTGGCTG
AATTTATCCCCTGAAAGTGGTTTTGGAGGAACCGGGATGGAGGAGGCCTTCCCCTGTGGGAA
TAGAATCGTCCACTCCTAGCCCTGGTTGCTTCTGATACACAGCCACTGCACACACACACTCA
CACTCACACTCCCTTGTCTGATGCCCCAAAGCCAATTCCTGGGCACCCTACCCTCTCTTAT
TTGGAGTTTCCGTTGGTTTACCTGAGTTTTCTCTGGGGTCTGCACAGAGGCAGCAGCATGGA
CATCATGGCCTCTCAGGTCCCTTTTGGTTCTCAGTTTCATTGGTTCCTCTTTCTGTTCCCCC
ATTGACTTCTGTGCCCCACCCTAGCCTTTTCCATAACCTTAGGTATTCAGTTTGGAGGGGTT
TTTTGTATTTTTGAGGATTCCTGTATTCTGTATCCTCTCCTCGCATCTCCTCACATGGAAAG
AAATAATGTATTTGTGCCTTCTGTGAGGAATGGGGGGAACAAGTGGTCCCAGGTATCCCCAT
TTCCAAGGCCCCCCTCCCTCTCCAGGTCCCCCACAGCAATAAAAGCTTCCCCCTGATATCC
ATCCCTTTGTAGTTTGAACAAATATATTTATATGATATGTAA
```

FIGURE 16

MEESPLSRAPSRGGVNFLNVARTYIPNTKVECHYTLPPGTMPSASDWIGIFKVEAACVRDYH
TFVWSSVPESTTDGSPIHTSVQFQASYLPKPGAQLYQFRYVNRQGQVCGQSPPFQFREPRPM
DELVTLEEADGGSDILLVVPKATVLQNQLDESQQERNDLMQLKLQLEGQVTELRSRVQELER
ALATARQEHTELMEQYKGISRSHGEITEERDILSRQQGDHVARILELEDDIQTISEKVLTKE
VELDRLRDTVKALTREQEKLLGQLKEVQADKEQSEAELQVAQQENHHLNLDLKEAKSWQEEQ
SAQAQRLKDKVAQMKDTLGQAQQRVAELEPLKEQLRGAQELAASSQQKATLLGEELASAAAA
RDRTIAELHRSRLEVAEVNGRLAELGLHLKEEKCQWSKERAGLLQSVEAEKDKILKLSAEIL
RLEKAVQEERTQNQVFKTELAREKDSSLVQLSESKRELTELRSALRVLQKEKEQLQEEKQEL
LEYMRKLEARLEKVADEKWNEDATTEDEEAAVGLSCPAALTDSEDESPEDMRLPPYGLCERG
DPGSSPAGPREASPLVVISQPAPISPHLSGPAEDSSSDSEAEDEKSVLMAAVQSGGEEANLL
LPELGSAFYDMASGFTVGTLSETSTGGPATPTWKECPICKERFPAESDKDALEDHMDGHFFF
STQDPFTFE

Important features:

Casein kinase II phosphorylation sites:
amino acids 28-31, 43-46, 68-71, 72-75, 129-132, 156-159, 208-211, 239-242, 282-285, 305-308, 376-379, 383-383, 468-471, 520-523, 521-524, 537-540, 539-542, 543-546, 593-596, 595-598, 597-600, 612-615, 639-642, 652-655, 667-670, 683-686

N-myristoylation sites:
amino acids 39-44, 107-112, 204-209, 414-419, 561-566, 613-618

Cell attachment sequence:
amino acids 557-559

Leucine zipper pattern sequence:
amino acids 163-184, 475-496, 482-503

FIGURE 17

GCAAGTTGGGAATTTTAGACTGTCACTGCACATGGACCTCTGGGAAGACGTCTGGCGAGAGC
TAGGCCCACTGGCCCTACAGACGGATCTTGCTGGCTCACCTGTCCCTGTGGAGGTTCCCCTG
GGAAGGCAAG<u>ATG</u>CCCAACAACAGCACTGCTCTGTCATTGGCCAATGTTACCTACATCACCA
TGGAAATTTTCATTGGACTCTGCGCCATAGTGGGCAACGTGCTGGTCATCTGCGTGGTCAAG
CTGAACCCCAGCCTGCAGACCACCACCTTCTATTTCATTGTCTCTCTAGCCCTGGCTGACAT
TGCTGTTGGGGTGCTGGTCATGCCTTTGGCCATTGTTGTCAGCCTGGGCATCACAATCCACT
TCTACAGCTGCCTTTTTATGACTTGCCTACTGCTTATCTTTACCCACGCCTCCATCATGTCC
TTGCTGGCCATCGCTGTGGACCGATACTTGCGGGTCAAGCTTACCGTCAGATTCAGAATTCC
TGGGCTCCCTGGGTGCATTCTATCATTCCAGTTGAAAGTTTGCTTCCTTCCAGTCATGTGGC
TCTTCATTCTACTCTCCTTGGCTCTCATTTCAGATGCCATGGTCATGGATGAAAAGGTCAAG
AGAAGCTTTGTGCTGGACACGGCTTCTGCCATCTGCAACTACAATGCCCACTACAAGAATCA
CCCCAAATACTGGTGCCGAGGCTATTTCCGTGACTACTGCAACATCATCGCCTTCTCCCCTA
ACAGCACCAATCATGTGGCCCTGAGGGACACAGGGAACCAGCTCATTGTCACTATGTCCTGC
CTGACCAAAGAGGACACGGGCTGGTACTGGTGTGGCATCCAGCGGGACTTTGCCAGGGATGA
CATGGATTTTACAGAGCTGATTGTAACTGACGACAAAGGAACCCTGGCCAATGACTTTTGGT
CTGGGAAAGACCTATCAGGCAACAAAACCAGAAGCTGCAAGGCTCCCAAAGTTGTCCGCAAG
GCTGACCGCTCCAGGACGTCCATTCTCATCATTTGCATACTGATCACGGGTTTGGGAATCAT
CTCTGTAATCAGTCATTTGACCAAAAGGAGGAGAAGTCAAAGGAATAGAAGGGTAGGCAACA
CTTTGAAGCCCTTCTCGCGTGTCCTGACTCCAAAGGAAATGGCTCCTACTGAACAGATG<u>TGA</u>
CTGAAGATTTTTTTAATTTAGTTCATAAAGTGATGCTACAACAGAATAATCACCATGACAAC
TGGCCCACACCTCAGAGACTGATTCTGATCTCCCAGGAATTCTGAAGGACCCTCTATCCTTG
ACAACAATCATTTGCAGCCAGGTAGCAACGGCGGTAGTCAGAGGAGCTATGATAGACCACAC
CCAAGCAAGGCTGCCCTCAAATAACATCTCAAGATCTTAGTTCTTATGCATTCCATCAGTCA
GAAGTGAAGAAGAGGTGGAGAATCTGGATTGGGGACCAGGAAATCACTTGTATTTTGTTAGC
CAATAAATTCCTAGCCAGTGTTGAATGAAAAAAAAAAAAA

FIGURE 18

MPNNSTALSLANVTYITMEIFIGLCAIVGNVLVICVVKLNPSLQTTTFYFIVSLALADIAVG
VLVMPLAIVVSLGITIHFYSCLFMTCLLLIFTHASIMSLLAIAVDRYLRVKLTVRFRIPGLP
GCILSFQLKVCFLPVMWLFILLSLALISDAMVMDEKVKRSFVLDTASAICNYNAHYKNHPKY
WCRGYFRDYCNIIAFSPNSTNHVALRDTGNQLIVTMSCLTKEDTGWYWCGIQRDFARDDMDF
TELIVTDDKGTLANDFWSGKDLSGNKTRSCKAPKVVRKADRSRTSILIICILITGLGIISVI
SHLTKRRRSQRNRRVGNTLKPFSRVLTPKEMAPTEQM

Important features of the protein:

Transmembrane domains:
amino acids 16-35, 62-80, 89-101, 134-152, 292-311

N-glycosylation sites.
amino acids 3-7, 4-8, 12-16, 204-208, 273-277 cAMP- and cGMP-dependent protein kinase phosphorylation site.
amino acids 316-320

N-myristoylation sites.
amino acids 122-128, 125-131, 258-264

Prokaryotic membrane lipoprotein lipid attachment site.
amino acids 214-225

G-protein coupled receptors proteins.
amino acids 29-59, 76-116

FIGURE 19

```
CTCGGGCGCGCACAGGCAGCTCGGTTTGCCCTGCGATTGAGCTGCGGGTCGCGGCCGGCGCCGGCCTCTCCAAT
GGCAAATGTGTGTGGCTGGAGGCGAGCGCGAGGCTTTCGGCAAAGGCAGTCGAGTGTTTGCAGACCGGGCGAG
TCCTGTGAAAGCAGATAAAAGAAAACATTTATTAACGTGTCATTACGAGGGGAGCGCCCGGCCGGGGCTGTCGC
ACTCCCCGCGGAACATTTGGCTCCCTCCAGCTCCGAGAGAGGAGAAGAAGAAAGCGGAAAAGAGGCAGATTCAC
GTCGTTTCCAGCCAAGTGGACCTGATCGATGGCCCTCCTGAATTTATCACGATATTTGATTTATTAGCGATGCC
CCCTGGTTTGTGTGTTACGCACACACACGTGCACACAAGGCTCTGGCTCGCTTCCCTCCCTCGTTTCCAGCTCC
TGGGCGAATCCCACATCTGTTTCAACTCTCCGCCGAGGGCGAGCAGGAGCGAGAGTGTGTCGAATCTGCGAGTG
AAGAGGGACGAGGGAAAAGAAACAAAGCCACAGACGCAACTTGAGACTCCCGCATCCCAAAAGAAGCACCAGAT
CAGCAAAAAAAGAAGATGGGCCCCCCGAGCCTCGTGCTGTGCTTGCTGTCCGCAACTGTGTTCTCCTGCTGGG
TGGAAGCTCGGCCTTCCTGTCGCACCACCGCCTGAAAGGCAGGTTTCAGAGGGACCGCAGGAACATCCGCCCCA
ACATCATCCTGGTGCTGACGGACGACCAGGATGTGGAGCTGGGTTCCATGCAGGTGATGAACAAGACCCGGCGC
ATCATGGAGCAGGGCGGGGCGCACTTCATCAACGCCTTCGTGACCACACCCATGTGCTGCCCCTCACGCTCCTC
CATCCTCACTGGCAAGTACGTCCACAACCACAACACCTACACCAACAATGAGAACTGCTCCTCGCCCTCCTGGC
AGGCACAGCACGAGAGCCGCACCTTTGCCGTGTACCTCAATAGCACTGGCTACCGGACAGCTTTCTTCGGGAAG
TATCTTAATGAATACAACGGCTCCTACGTGCCACCCGGCTGGAAGGAGTGGGTCGGACTCCTTAAAAACTCCCG
CTTTTATAACTACACGCTGTGTCGGAACGGGGTGAAAGAGAAGCACGGCTCCGACTACTCCAAGGATTACCTCA
CAGACCTCATCACCAATGACAGCGTGAGCTTCTTCCGCACGTCCAAGAAGATGTACCCGCACAGGCCAGTCCTC
ATGGTCATCAGCCATGCAGCCCCCACGGCCCTGAGGATTCAGCCCCACAATATTCACGCCTCTTCCCAAACGC
ATCTCAGCACATCACGCCGAGCTACAACTACGCGCCCAACCCGGACAAACACTGGATCATGCGCTACACGGGGC
CCATGAAGCCCATCCACATGGAATTCACCAACATGCTCCAGCGGAAGCGCTTGCAGACCCTCATGTCGGTGGAC
GACTCCATGGAGACGATTTACAACATGCTGGTTGAGACGGGCGAGCTGGACAACACGTACATCGTATACACCGC
CGACCACGGTTACCACATCGGCCAGTTTGGCCTGGTGAAAGGGAAATCCATGCCATATGAGTTTGACATCAGGG
TCCCGTTCTACGTGAGGGGCCCCAACGTGGAAGCCGGCTGTCTGAATCCCCACATCGTCCTCAACATTGACCTG
GCCCCCACCATCCTGGACATTGCAGGCCTGGACATACCTGCGGATATGGACGGGAAATCCATCCTCAAGCTGCT
GGACACGGAGCGGCCGGTGAATCGGTTTCACTTGAAAAAGAAGATGAGGGTCTGGCGGGACTCCTTCTTGGTGG
AGAGAGGCAAGCTGCTACACAAGAGAGACAATGACAAGGTGGACGCCCAGGAGGAGAACTTTCTGCCCAAGTAC
CAGCGTGTGAAGGACCTGTGTCAGCGTGCTGAGTACCAGACGGCGTGTGAGCAGCTGGGACAGAAGTGGCAGTG
TGTGGAGGACGCCACGGGAAGCTGAAGCTGCATAAGTGCAAGGGCCCCATGCGGCTGGGCGGCAGCAGAGCCC
TCTCCAACCTCGTGCCCAAGTACTACGGGCAGGGCAGCGAGGCCTGCACCTGTGACAGCGGGGACTACAAGCTC
AGCCTGGCCGGACGCCGGAAAAAACTCTTCAAGAAGAAGTACAAGGCCAGCTATGTCCGCAGTCGCTCCATCCG
CTCAGTGCCCATCGAGGTGGACGGCAGGGTGTACCACGTAGGCCTGGGTGATGCCGCCCAGCCCCGAAACCTCA
CCAAGCGGCACTGGCCAGGGGCCCCTGAGGACCAAGATGACAAGGATGGTGGGGACTTCAGTGGCACTGGAGGC
CTTCCCGACTACTCAGCCGCCAACCCCATTAAAGTGACACATCGGTGCTACATCCTAGAGAACGACACAGTCCA
GTGTGACCTGGACCTGTACAAGTCCCTGCAGGCCTGGAAAGACCACAAGCTGCACATCGACCACGAGATTGAAA
CCCTGCAGAACAAAATTAAGAACCTGAGGGAAGTCCGAGGTCACCTGAAGAAAAAGCGGCCAGAAGAATGTGAC
TGTCACAAAATCAGCTACCACACCCAGCACAAAGGCCGCCTCAAGCACAGAGGCTCCAGTCTGCATCCTTTCAG
GAAGGGCCTGCAAGAGAAGGACAAGGTGTGGCTGTTGCGGGAGCAGAAGCGCAAGAAGAAACTCCGCAAGCTGC
TCAAGCGCCTGCAGAACAACGACACGTGCAGCATGCCAGGCCTCACGTGCTTCACCCACGACAACCAGCACTGG
CAGACGGCCGCCTTTCTGGACACTGGGGCCTTTCTGTGCCTGCAGCGCCAACAATAACACGTACTGGTGCAT
GAGGACCATCAATGAGACTCACAATTTCCTCTTCTGTGAATTTGCAACTGGCTTCCTAGAGTACTTTGATCTCA
ACACAGACCCCTACCAGCTGATGAATGCAGTGAACACACTGGACAGGGATGTCCTCAACCAGCTACACGTACAG
CTCATGGAGCTGAGGAGCTGCAAGGGTTACAAGCAGTGTAACCCCCGGACTCGAAACATGGACCTGGATGGAGG
AAGCTATGAGCAATACAGGCAGTTTCAGCGTCGAAAGTGGCCAGAAATGAAGAGACCTTCTTCCAAATCACTGG
GACAACTGTGGGAAGGCTGGGAAGGTTAAGAAACAACAGAGGTGGACCTCCAAAAACATAGAGGCATCACCTGA
CTGCACAGGCAATGAAAAACCATGTGGGTGATTTCCAGCAGACCTGTGCTATTGGCCAGGAGGCCTGAGAAAGC
AAGCACGCACTCTCAGTCAACATGACAGATTCTGGAGGATAACCAGCAGGAGCAGAGATAACTTCAGGAAGTCC
ATTTTTGCCCCTGCTTTTGCTTTGGATTATACCTCACCAGCTGCACAAAATGCATTTTTCGTATCAAAAAGTC
ACCACTAACCCTCCCCAGAAGCTCACAAAGGAAAACGGAGAGAGCGAGCGAGAGAGATTTCCTTGGAAATTTC
TCCCAAGGGCGAAAGTCATTGGAATTTTTAAATCATAGGGGAAAAGCAGTCCTGTTCTAAATCCTCTTATTCTT
TTGGTTTGTCACAAAGAAGGAACTAAGAAGCAGGACAGAGGCAACGTGGAGAGGCTGAAAACAGTGCAGACG
TTTGACAATGAGTCAGTAGCACAAAAGAGATGACATTTACCTAGCACTATAAACCCTGGTTGCCTCTGAAGAAA
CTGCCTTCATTGTATATATGTGACTATTTACATGTAATCAACATGGGAACTTTTAGGGGAACCTAATAAGAAAT
CCCAATTTTCAGGAGTGGTGGTGTCAATAAACGCTCTGTGGCCAGTGTAAAAGAAAAA
```

FIGURE 20

```
MGPPSLVLCLLSATVFSLLGGSSAFLSHHRLKGRFQRDRRNIRPNIILVLTDDQDVELGSMQ
VMNKTRRIMEQGGAHFINAFVTTPMCCPSRSSILTGKYVHNHNTYTNNENCSSPSWQAQHES
RTFAVYLNSTGYRTAFFGKYLNEYNGSYVPPGWKEWVGLLKNSRFYNYTLCRNGVKEKHGSD
YSKDYLTDLITNDSVSFFRTSKKMYPHRPVLMVISHAAPHGPEDSAPQYSRLFPNASQHITP
SYNYAPNPDKHWIMRYTGPMKPIHMEFTNMLQRKRLQTLMSVDDSMETIYNMLVETGELDNT
YIVYTADHGYHIGQFGLVKGKSMPYEFDIRVPFYVRGPNVEAGCLNPHIVLNIDLAPTILDI
AGLDIPADMDGKSILKLLDTERPVNRFHLKKKMRVWRDSFLVERGKLLHKRDNDKVDAQEEN
FLPKYQRVKDLCQRAEYQTACEQLGQKWQCVEDATGKLKLHKCKGPMRLGGSRALSNLVPKY
YGQGSEACTCDSGDYKLSLAGRRKKLFKKKYKASYVRSRSIRSVAIEVDGRVYHVGLGDAAQ
PRNLTKRHWPGAPEDQDDKDGGDFSGTGGLPDYSAANPIKVTHRCYILENDTVQCDLDLYKS
LQAWKDHKLHIDHEIETLQNKIKNLREVRGHLKKKRPEECDCHKISYHTQHKGRLKHRGSSL
HPFRKGLQEKDKVWLLREQKRKKKLRKLLKRLQNNDTCSMPGLTCFTHDNQHWQTAPFWTLG
PFCACTSANNNTYWCMRTINETHNFLFCEFATGFLEYFDLNTDPYQLMNAVNTLDRDVLNQL
HVQLMELRSCKGYKQCNPRTRNMDLDGGSYEQYRQFQRRKWPEMKRPSSKSLGQLWEGWEG
```

```
Important features:
Signal peptide:
amino acids 1-17

Sulfatases signature 1.
amino acids 86-99

Homologous region to sulfatase:
amino acids 87-106, 133-146, 216-229, 291-320, 365-375

N-glycosylation sites.
amino acids 65-69, 112-116, 132-136, 149-153, 171-175, 198-202,
241-245, 561-565, 608-612, 717-721, 754-758, 764-768
```

FIGURE 21

GGGCGCGCGAGAGCTGCTAGGGCGGTTTCTCTGCCTCGGGCCTGTTGGGCAGGGCCGGCT
AAGGTGCGCGTGCTCGCTGGTTCTAACCCTTCTGTTGGGCGTTTCTGCTGAGAGGCGGGA
GGCGCTGAGAGTCTGTGCGGAGGTCCGTGGACAGACTGCTTTGCTCGTTGTTGCTCTTCG
GAGGCGGCGATCCCCGAAGGCGAGCTGAAATACGGCTGCAGGCTACAATTTGCAGCCGAC
GATTATGGAAGACGGAAGCGGGAGAGGTGGCCCACCCTATGGAGCGCTTGTGCTCGGAT
GGCTTCGCATTTCCCCAATACCCCATTAAACCGTATCATCTGAAGAGGATCCACAGAGCT
GTCTTACATGGTAATCTAGAGAAACTGAAGTACCTTCTGCTCACGTATTATGACGCCAAT
AAGAGAGACAGGAAGGAAAGGACCGCCCTACATTTGGCCTGTGCCACTGGCCAACCGGAA
ATGGTACATCTCCTGGTGTCCAGAAGATGTGAGCTTAACCTCTGCGACCGTGAAGACAGG
ACACCTCTGATCAAGGCTGTACAACTGAGGCAGGAGGCTTGTGCAACTCTTCTGCTGCAA
AATGGCGCCAATCCAAATATTACGGATTTCTTTGGAAGGACTGCTCTGCACTACGCTGTG
TATAATGAAGATACATCCATGATAGAAAAACTTCTTTCACATGGTACAAATATTGAAGAA
TGCAGCAAGGTATAGGTCAACCAATGTTATTTTCAAACTATCTGAAATGAATTTATTTTA
ACATTGACACATGTAAGGGTCAATTTTTCATATTTGGAAGCTCAAACATTCCTTGAATGA
AAATATTTTGAAATGCCTTAACTGTCTAAGATTTTACTTTAAATATTGGAACTTTTAAAG
AAGCATTATAGGGAACAGCCTTTTTTCATGCACTTATGGTAAATAACTATAAAAACAAAT
GAATTACAATAAATTTATAATTCATGACAACTGAATTTGGGAAAGGTAATAGTTAAGTGT
TTTTCCACTAAATTACTTTTT

FIGURE 22

MERLCSDGFAFPQYPIKPYHLKRIHRAVLHGNLEKLKYLLLTYYDANKRDRKERTALHLACA
TGQPEMVHLLVSRRCELNLCDREDRTPLIKAVQLRQEACATLLLQNGANPNITDFFGRTALH
YAVYNEDTSMIEKLLSHGTNIEECSKV

Important features of the protein:

N-glycosylation site.
amino acids 113-117

N-myristoylation site.
amino acids 109-115

Microbodies C-terminal targeting signal.
amino acids 149-153

FIGURE 23

GAGGCAGAAAGGCAGAAAGGAGAAAATTCAGGATAACTCTCCTGAGGGGTGAGCCAAGCCCT
GCCATGTAGTGCACGCAGGACATCAACAAACACAGATAACAGGAAATGATCCATTCCCTGTG
GTCACTTATTCTAAAGGCCCCAACCTTCAAAGTTCAAGTAGTGAT<u>AT</u>GGATGACTCCACAGA
AAGGGAGCAGTCACGCCTTACTTCTTGCCTTAAGAAAAGAGAAGAAATGAAACTGAAGGAGT
GTGTTTCCATCCTCCCACGGAAGGAAAGCCCCTCTGTCCGATCCTCCAAAGACGGAAAGCTG
CTGGCTGCAACCTTGCTGCTGGCACTGCTGTCTTGCTGCCTCACGGTGGTGTCTTTCTACCA
GGTGGCCGCCCTGCAAGGGGACCTGGCCAGCCTCCGGGCAGAGCTGCAGGGCCACCACGCGG
AGAAGCTGCCAGCAGGAGCAGGAGCCCCCAAGGCCGGCCTGGAGGAAGCTCCAGCTGTCACC
GCGGGACTGAAAATCTTTGAACCACCAGCTCCAGGAGAAGGCAACTCCAGTCAGAACAGCAG
AAATAAGCGTGCCGTTCAGGGTCCAGAAGAAACAGTCACTCAAGACTGCTTGCAACTGATTG
CAGACAGTGAAACACCAACTATACAAAAAGGATCTTACACATTTGTTCCATGGCTTCTCAGC
TTTAAAAGGGGAAGTGCCCTAGAAGAAAAGAGAATAAAATATTGGTCAAAGAAACTGGTTA
CTTTTTTATATATGGTCAGGTTTTATATACTGATAAGACCTACGCCATGGGACATCTAATTC
AGAGGAAGAAGGTCCATGTCTTTGGGGATGAATTGAGTCTGGTGACTTTGTTTCGATGTATT
CAAAATATGCCTGAAACACTACCCAATAATTCCTGCTATTCAGCTGGCATTGCAAAACTGGA
AGAAGGAGATGAACTCCAACTTGCAATACCAAGAGAAATGCACAAATATCACTGGATGGAG
ATGTCACATTTTTTGGTGCATTGAAACTGCTG<u>TGA</u>CCTACTTACACCATGTCTGTAGCTATT
TTCCTCCCTTTCTCTGTACCTCTAAGAAGAAAGAATCTAACTGAAAATACCAAAAAAAAAAA
AAAAA

FIGURE 24

MDDSTEREQSRLTSCLKKREEMKLKECVSILPRKESPSVRSSKDGKLLAATLLLALLSCCLT
VVSFYQVAALQGDLASLRAELQGHHAEKLPAGAGAPKAGLEEAPAVTAGLKIFEPPAPGEGN
SSQNSRNKRAVQGPEETVTQDCLQLIADSETPTIQKGSYTFVPWLLSFKRGSALEEKENKIL
VKETGYFFIYGQVLYTDKTYAMGHLIQRKKVHVFGDELSLVTLFRCIQNMPETLPNNSCYSA
GIAKLEEGDELQLAIPRENAQISLDGDVTFFGALKLL

Transmembrane domain:

amino acids 47-72

N-glycosylation site.

amino acids 124-127, 242-245 cAMP- and cGMP-dependent protein kinase phosphorylation site.

amino acids 33-36, 173-176

N-myristoylation site.

amino acids 96-101

TNF family proteins.

amino acids 172-206

FIGURE 25

```
CTGCTTGGATACCTCCAGTCCCCAAACTGTGTTCCAGGAGTTTTCTTGGCCGAAGCTGCCCG
ATGTTTGAGCCTTTTCTTCCCAGAGAAGAAGATGGACTGAAAGCTGCCAGTTGGGGACTTTT
TGTGATCACGGCGTTGCAGCGTTTTAAAGGAGGTGATGGGGCTTGCGCTGGCTTGTCTTCCC
ACCCAAGTGAAGAGTTGATGTTCACTGGTTATGCTTAGACAATGTGCAGTTTGTGTTAATTT
AAAATTTTGGGTGGGATAGGGGCATAGGCTTGTGAAGGGCAGTCCGGATCCGGAGGAACTCG
TCTTTGTCCCTGGTAGGAGAGACACCCCAGTCTATCCTCGATGCCGTCAGCCTTGGCCATC
TTCACTTGCCGCCCGAACTCGCACCCGTTTCAGGAGCGTCATGTCTACCTGGACGAGCCCAT
CAAAATCGGCCGCTCAGTGGCCCGCTGTCGACCAGCGCAGAATAATGCCACTTTTGATTGCA
AAGTGCTATCAAGGAACCACGCTCTCGTCTGGTTTGATCACAAGACGGGCAAGTTTTATCTT
CAAGACACTAAAAGTAGTAATGGTACTTTTATAAATAGCCAGAGATTGAGTCGAGGCTCTGA
AGAAAGTCCACCATGTGAAATTCTTTCCGGTGACATTATCCAGTTTGGAGTAGACGTGACAG
AGAATACACGGAAAGTTACCCATGGGTGTATTGTTTCCACAATAAAACTTTTTCTACCAGAT
GGTATGGAAGCCCGGCTCCGCTCAGATGTCATCCATGCACCATTACCAAGTCCTGTTGACAA
AGTTGCTGCTAACACTCCAAGTATGTACTCTCAGGAACTATTCCAGCTTTCTCAGTATCTAC
AGGAGGCCTTACATCGGGAACAAATGTTGGAACAGAAGTTAGCCACGCTTCAGCGGCTACTA
GCCATCACCCAAGAGGCTTCAGATACCAGTTGGCAGGCTTTAATAGATGAAGATAGACTCTT
ATCACGGTTAGAAGTTATGGGAAACCAATTACAGGCATGCTCCAAAAATCAAACAGAAGATA
GTTTACGAAAGGAACTTATAGCATTACAAGAGGATAAACATAACTATGAGACAACAGCCAAA
GAGTCCCTGAGGCGGGTTCTTCAGGAGAAAATTGAAGTGGTTAGAAAACTTTCAGAAGTTGA
GCGAAGTCTGAGTAATACTGAAGATGAATGTACCCATCTGAAAGAAATGAATGAAAGGACTC
AGGAAGAATTAAGAGAATTAGCCAACAAATATAATGGAGCAGTTAATGAGATTAAAGATTTA
TCTGATAAATTAAAGGTAGCAGAGGGAAAACAAGAGGAAATCCAACAGAAGGGACAGGCTGA
GAAAAAGAATTACAACATAAAATAGATGAAATGGAAGAAAAAGAACAGGAGCTCCAGGCAA
AAATAGAAGCTTTGCAAGCTGATAATGATTTCACCAATGAAAGGCTAACAGCTTTACAAGTA
CGGTTAGAACATCTTCAGGAGAAAACTCTTAAAGAATGCAGCAGCTTGGCTGATCGTCGAAG
GGCATCTAACCAAAGCGGTAGAAGAAACAAAGCTTTCAAAAGGTTTGTTTTCTGTTTTTCTA
TGTTTTTTGACAGTTCTTTTGGATAATGAAGGTTAGTGTATATTTTCAAGGTTATAGTATTT
TAACCATCAGTTTACTTCTTATAGCTCACAAAATAGCAAGCCAGTAACAGTATCAGATAATA
TATAAAATAATCAGACTTCTGTTTTAAGAAGGGTATCGTAACTGGAATGTGTCTTTTTAAGT
GGATGTATATTTATGGTTTTTTGAATGTTAGTACTTGATATAGGTTTCTTTAGGTATTAAAG
ATTTGTTGCAATCTCTGTCATTCCCAGCATTAATTTCAGCTTTGATCTCAAATTTTAATCAA
ACACAATGTAAGTCGTTTGTGATACAACTTAAGTGAAACATGCTTGCACTTCTATTTTGGGG
GTTACAGTACCTTTAAAATCTCTTATGATGTTTAATATTTCCTTAATTTTTGGCATCTCAGT
TTGATTTAAACAAAATTAATGACTTTTGTGAATGTAGAATCTTCTTATATTTTATGAGTAGT
CCAGTAATTGCCCAAAGTAGTTTATTGTGTTAATTCTGTTACAGTTGTCAGAGAAGAAAAGT
GAGTTTTAAAGCACCATATTGTCAAGTCACTTTTATACATAGGGAAATTAGGCAAATAAATT
TGGTGGCATGTGTTTATCATAGTAGAACTTTCATTAGACTATACCAGTATAAAATTTAAAAC
TAGATTCACAGTCCTTTTGGCCAATTAAAACATTGAGTTACAAAAGTTTGAGATACTTAATT
TTAGTACATTCTATTTTATTAAAGTAACTGGATTCATTTGACTTTTTTAACCATGTAAGAGG
ATGGTGTTATTTCAAATATCTCGTGGTTTCCATTCTGAATTTGTGCACGGCAGATGCCATA
TTTGGGGAAAAAATGCATAGAATATGCATCATTAATATTGTTTTGGCAAACAGGCATTGAGT
TTCAGAACAGTGAACTATTTTTAGTACATATGGCAATTTTTTTCACCTTATTAAAGTGAGAT
GAGAACAGACCTTAAAATAGCTTTTACCTCACCATCCAAATACCTATTCAGATTAGTTGGTT
GAATAGCCAGCACTTTGAAGTAGAGCCTTAGG
```

FIGURE 26

MEARLRSDVIHAPLPSPVDKVAANTPSMYSQELFQLSQYLQEALHREQMLEQKLATLQRLLA
ITQEASDTSWQALIDEDRLLSRLEVMGNQLQACSKNQTEDSLRKELIALQEDKHNYETTAKE
SLRRVLQEKIEVVRKLSEVERSLSNTEDECTHLKEMNERTQEELRELANKYNGAVNEIKDLS
DKLKVAEGKQEEIQQKGQAEKKELQHKIDEMEEKEQELQAKIEALQADNDFTNERLTALQVR
LEHLQEKTLKECSSLADRRRASNQSGRRNKAFKRFVFCFSMFFDSSFG

Important features of the protein:
N-glycosylation sites.
amino acids 98-102, 271-275 cAMP- and cGMP-dependent protein kinase phosphorylation site.
amino acids 138-142, 267-271

Amidation site.
amino acids 273-277

Tropomyosins proteins.
amino acids 169-217

FIGURE 27

```
GAACCTGGCGCCGCCGGAACTGATCGCGGCCTAGTCCCGACGCGTGTGCTAGTGAGCCGG
AGCCGGCGACGGCGGCAGTGGCGGCCCGGCCTGCAGGAGCCCGACGGGGTCTCTGCCATGGG
GGAGTGACGCGCCTGCACCCGCTGTTCCGCGGCAGCGGCGAGACATGAGGAGACCCCGCGAC
AGGGGCAGCGGCGGCGGCTCGTGAGCCCCGGGATGGAGGAGAAATACGGCGGGGACGTGCTG
GCCGGCCCCGGCGGCGGCGGCGGCCTTGGCCGGTGGACGTACCCAGCGCTCGATTAACAAA
ATATATTGTGTTACTATGTTTCACTAAATTTTTGAAGGCTGTGGGACTTTTCGAATCATATG
ATCTCCTAAAAGCTGTTCACATTGTTCAGTTCATTTTTATATTAAAACTTGGGACTGCATTT
TTTATGGTTTTGTTTCAAAAGCCATTTTCTTCTGGGAAAACTATTACCAAACACCAGTGGAT
CAAAATATTTAAACATGCAGTTGCTGGGTGTATTATTTCACTCTTGTGGTTTTTTGGCCTCA
CTCTTTGTGGACCACTAAGGACTTTGCTGCTATTTGAGCACAGTGATATTGTTGTCATTTCA
CTACTCAGTGTTTTGTTCACCAGTTCTGGAGGAGGACCAGCAAAGACAAGGGGAGCTGCTTT
TTTCATTATTGCTGTGATCTGTTTATTGCTTTTTGACAATGATGATCTCATGGCTAAAATGG
CTGAACACCCTGAAGGACATCATGACAGTGCTCTAACTCATATGCTTTACACAGCCATTGCC
TTCTTAGGTGTGGCAGATCACAAGGGTGGAGTATTATTGCTAGTACTGGCTTTGTGTTGTAA
AGTTGGTTTTCATACAGCTTCCAGAAAGCTCTCTGTCGACGTTGGTGGAGCTAAACGTCTTC
AAGCTTTATCTCATCTTGTTTCTGTGCTTCTCTTGTGCCCATGGGTCATTGTTCTTTCTGTG
ACAACTGAGAGTAAAGTGGAGTCTTGGTTTTCTCTCATTATGCCTTTTGCAACGGTTATCTT
TTTTGTCATGATCCTGGATTTCTACGTGGATTCCATTTGTTCAGTCAAAATGGAAGTTTCCA
AATGTGCTCGTTATGGATCCTTTCCCATTTTTATTAGTGCTCTCCTTTTTGGAAATTTTTGG
ACACATCCAATAACAGACCAGCTTCGGGCTATGAACAAAGCAGCACACCAGGAGAGCACTGA
ACACGTCCTGTCTGGAGGAGTGGTAGTGAGTGCTATATTCTTCATTTGTCTGCCAATATCT
TATCATCTCCCTCTAAGAGAGGACAAAAAGGTACCCTTATTGGATATTCTCCTGAAGGAACA
CCTCTTTATAACTTCATGGGTGATGCTTTTCAGCATAGCTCTCAATCGATCCCTAGGTTTAT
TAAGGAATCACTAAAACAAATTCTTGAGGAGAGTGACTCTAGGCAGATCTTTTACTTCTTGT
GCTTGAATCTGCTTTTTACCTTTGTGGAATTATTCTATGGCGTGCTGACCAATAGTCTGGGC
CTGATCTCGGATGGATTCCACATGCTTTTTGACTGCTCTGCTTTAGTCATGGGACTTTTTGC
TGCCCTGATGAGTAGGTGGAAAGCCACTCGGATTTTCTCCTATGGGTACGGCCGAATAGAAA
TTCTGTCTGGATTTATTAATGGACTTTTTCTAATAGTAATAGCGTTTTTTGTGTTTATGGAG
TCAGTGGCTAGATTGATTGATCCTCCAGAATTAGACACTCACATGTTAACACCAGTCTCAGT
TGGAGGGCTGATAGTAAACCTTATTGGTATCTGTGCCTTTAGCCATGCCCATAGCCATGCCC
ATGGAGCTTCTCAAGGAAGCTGTCACTCATCTGATCACAGCCATTCACACCATATGCATGGA
CACAGTGACCATGGGCATGGTCACAGCCACGGATCTGCGGGTGGAGGCATGAATGCTAACAT
GAGGGGTGTATTTCTACATGTTTGGCAGATACACTTGGCAGCATTGGTGTGATCGTATCCA
CAGTTCTTATAGAGCAGTTTGGATGGTTCATCGCTGACCCACTCTGTTCTCTTTCTACTGCT
ATATTAATATTTCTCAGTGTTGTTCCACTGATTAAAGATGCCTGCCAGGTTCTACTCCTGAG
ATTGCCACCAGAATATGAAAAGAACTACATATTGCTTTAGAAAAGATACAGAAAATTGAAG
GATTAATATCATACCGAGACCCTCATTTTTGGCGTCATTCTGCTAGTATTGTGGCAGGAACA
ATTCATATACAGGTGACATCTGATGTGCTAGAACAAAGAATAGTACAGCAGGTTACAGGAAT
ACTTAAAGATGCTGGAGTAAACAATTTAACAATTCAAGTGGAAAAGGAGGCATACTTTCAAC
ATATGTCTGGCCTAAGTACTGGATTTCATGATGTTCTGGCTATGACAAAACAAATGGAATCC
ATGAAATACTGCAAAGATGGTACTTACATCATGTGAGATAACTCAAGAATTACCCCTGGAGA
ATAAACAATGAAGATTAAATGACTCAGTATTTGTAATATTGCCAGAAGGATAAAAATTACAC
ATTAACTGTACAGAAACAGAGTTCCCTACTACTGGATCAAGGAATCTTTCTTGAAGGAAATT
TAAATACAGAATGAAACATTAATGGTAAAAAAAA
```

FIGURE 28

MEEKYGGDVLAGPGGGGGLGPVDVPSARLTKYIVLLCFTKFLKAVGLFESYDLLKAVHIVQF
IFILKLGTAFFMVLFQKPFSSGKTITKHQWIKIFKHAVAGCIISLLWFFGLTLCGPLRTLLL
FEHSDIVVISLLSVLFTSSGGGPAKTRGAAFFIIAVICLLLFDNDDLMAKMAEHPEGHHDSA
LTHMLYTAIAFLGVADHKGGVLLLVLALCCKVGFHTASRKLSVDVGGAKRLQALSHLVSVLL
LCPWVIVLSVTTESKVESWFSLIMPFATVIFFVMILDFYVDSICSVKMEVSKCARYGSFPIF
ISALLFGNFWTHPITDQLRAMNKAAHQESTEHVLSGGVVVSAIFFILSANILSSPSKRGQKG
TLIGYSPEGTPLYNFMGDAFQHSSQSIPRFIKESLKQILEESDSRQIFYFLCLNLLFTFVEL
FYGVLTNSLGLISDGFHMLFDCSALVMGLFAALMSRWKATRIFSYGYGRIEILSGFINGLFL
IVIAFFVFMESVARLIDPPELDTHMLTPVSVGGLIVNLIGICAFSHAHSHAHGASQGSCHSS
DHSHSHHMHGHSDHGHGHSHGSAGGGMNANMRGVFLHVLADTLGSIGVIVSTVLIEQFGWFI
ADPLCSLSTAILIFLSVVPLIKDACQVLLLRLPPEYEKELHIALEKIQKIEGLISYRDPHFW
RHSASIVAGTIHIQVTSDVLEQRIVQQVTGILKDAGVNNLTIQVEKEAYFQHMSGLSTGFHD
VLAMTKQMESMKYCKDGTYIM

Important features of the protein:

Signal peptide:

amino acids 1-46

Transmembrane domains:

amino acids 59-77, 101-119, 150-167, 205-223, 239-258, 267-284, 305-324, 343-360, 421-440, 452-469, 486-505, 522-539, 592-612, 621-641

N-glycosylation site.

amino acids 721-725

Glycosaminoglycan attachment site.

amino acids 143-147 cAMP- and cGMP-dependent protein kinase phosphorylation site.

amino acids 225-229

Tyrosine kinase phosphorylation sites.

amino acids 750-758, 756-764

N-myristoylation sites.

amino acids 14-20, 46-52, 102-108, 112-118, 144-150, 317-323, 347-353, 369-375, 372-378, 437-443, 462-468, 529-535, 549-555, 553-559, 579-585, 582-588, 583-589, 584-590, 605-611, 737-743

Multicopper oxidases protein:

amino acids 561-569

FIGURE 29

```
GGCACGAGGGCAGGATATTAGAAATGGCTACTCCCCAGTCAATTTTCATCTTTGCAATCTGC
ATTTTAATGATAACAGAATTAATTCTGGCCTCAAAAAGCTACTATGATATCTTAGGTGTGCC
AAAATCGGCATCAGAGCGCCAAATCAAGAAGGCCTTTCACAAGTTGGCCATGAAGTACCACC
CTGACAAAAATAAGAGCCCGGATGCTGAAGCAAAATTCAGAGAGATTGCAGAAGCATATGAA
ACACTCTCAGATGCTAATAGACGAAAGAGTATGATACACTTGGACACAGTGCTTTTACTAG
TGGTAAAGGACAAAGAGGTAGTGGAAGTTCTTTTGAGCAGTCATTTAACTTCAATTTTGATG
ACTTATTTAAAGACTTTGGCTTTTTTGGTCAAAACCAAAACACTGGATCCAAGAAGCGTTTT
GAAAATCATTTCCAGACACGCCAGGATGGTGGTTCCAGTAGACAAAGGCATCATTTCCAAGA
ATTTTCTTTTGGAGGTGGATTATTTGATGACATGTTTGAAGATATGGAGAAAATGTTTTCTT
TTAGTGGTTTTGACTCTACCAATCAGCATACAGTACAGACTGAAAATAGATTTCATGGATCT
AGCAAGCACTGCAGGACTGTCACTCAACGAAGAGGAAATATGGTTACTACATACACTGACTG
TTCAGGACAGTAGTTCTTATTCTATTCTCACTAAATCCAACTGGTTGACTCTTCCTCATTAT
CTTTGATGCTAAACAATTTTCTGTGAACTATTTTGACAAGTGCATGATTTCACTTTAAACAA
TTTGATATAGCTATTAAATATATTTAAGGGTTTTTTTTTTGACAAATTCAACATTCAACGA
GTAGACAAAATGCTAATTATTTCCCTGATTAGGAAAGTTTCTTTAAAAAACACGTAATTTTG
CCTAGTGCTTTTTCTCTACCTGCCCTTGGGCTCACTAATATCACCAGTATTATTACCAAGAA
AATATTGAGTTTACCTGATTAAACTTTAAAAGTTAATTGTAGATTTAAATTGTGTGAACCTA
ATGATTTTTGCAGTGAAACCTTTACTAATTCAAAGTTGCATGTTCTATGACATCTGTGACTT
GCGTTGCAGAGTGTACATGAAACTGTATAATTGAGTCATTCAGTAAAGGAGAACAGTATCTT
GGTTAATTGCTACTGAAAGGTTGAGAAAGGAATGGTTTGATATTTACCACAGCGCTGTGCCT
TTCTACAGTAGAACTGGGGTAAAGGAAATGGTTTTATTGCCCATAGTCATTTAGGCTGGAAA
AAAGTTGAAAACTTAACGAAATATTGCCAAGAGATTGTTATGTGTTTGGTTCCAGCCTAAAA
ATGATTTTGTAGTGTTGAAATCATAGCTACTTACATAGCTTTTTCATATTTCTTTCTTAGTT
GTTGGCACTCTTAGGTCTTAGTATGGATTTATGTGTTTGTGTGTGTAGTTTATCCTCTCT
CTCATCTTTATCTAGAGATTGACTGATACCTCATTCTGTTTGTAAAACCAGCCAGTAATTTC
TGTGCAACCTTACTATGTGCAATATTTTTAAATCCTGAGAAATGTGTGCTTTTGTTTTCGGA
TAGACTTATTTCTTTAGTTCTGCACTTTTCCACATTATACTCCATATGAGTATTAATCCTAT
GGATACATATTAAAACAAGTGTCTCAT
```

FIGURE 30

MATPQSIFIFAICILMITELILASKSYYDILGVPKSASERQIKKAFHKLAMKYHPDKNKSPD
AEAKFREIAEAYETLSDANRRKEYDTLGHSAFTSGKGQRGSGSSFEQSFNFNFDDLFKDFGF
FGQNQNTGSKKRFENHFQTRQDGGSSRQRHHFQEFSFGGGLFDDMFEDMEKMFSFSGFDSTN
QHTVQTENRFHGSSKHCRTVTQRRGNMVTTYTDCSGQ

Important features of the protein:

Signal peptide:

amino acids 1-23

Nt-dnaJ domain signature.

amino acids 27-59, 66-90

Glycosaminoglycan attachment site.

amino acids 96-100

N-myristoylation sites.

amino acids 32-38, 99-105, 102-108, 126-132, 211-217

FIGURE 31

```
AAAGTTACATTTTCTCTGGAACTCTCCTAGGCCACTCCCTGCTGATGCAACATCTGGGTTTG
GGCAGAAAGGAGGGTGCTTCGGAGCCCGCCCTTTCTGAGCTTCCTGGGCCGGCTCTAGAACA
ATTCAGGCTTCGCTGCGACTCAGACCTCAGCTCCAACATATGCATTCTGAAGAAAGATGGCT
GAGATGGACAGAATGCTTTATTTTGGAAAGAAACAATGTTCTAGGTCAAACTGAGTCTACCA
AATGCAGACTTTCACAATGGTTCTAGAAGAAATCTGGACAAGTCTTTTCATGTGGTTTTTCT
ACGCATTGATTCCATGTTTGCTCACAGATGAAGTGGCCATTCTGCCTGCCCCTCAGAACCTC
TCTGTACTCTCAACCAACATGAAGCATCTCTTGATGTGGAGCCCAGTGATCGCGCCTGGAGA
AACAGTGTACTATTCTGTCGAATACCAGGGGGAGTACGAGAGCCTGTACACGAGCCACATCT
GGATCCCCAGCAGCTGGTGCTCACTCACTGAAGGTCCTGAGTGTGATGTCACTGATGACATC
ACGGCCACTGTGCCATACAACCTTCGTGTCAGGGCCACATTGGGCTCACAGACCTCAGCCTG
GAGCATCCTGAAGCATCCCTTTAATAGAAACTCAACCATCCTTACCCGACCTGGGATGGAGA
TCACCAAAGATGGCTTCCACCTGGTTATTGAGCTGGAGGACCTGGGGCCCAGTTTGAGTTC
CTTGTGGCCTACTGGAGGAGGGAGCCTGGTGCCGAGGAACATGTCAAAATGGTGAGGAGTGG
GGGTATTCCAGTGCACCTAGAAACCATGGAGCCAGGGGCTGCATACTGTGTGAAGGCCCAGA
CATTCGTGAAGGCCATTGGGAGGTACAGCGCCTTCAGCCAGACAGAATGTGTGGAGGTGCAA
GGAGAGGCCATTCCCCTGGTACTGGCCCTGTTTGCCTTTGTTGGCTTCATGCTGATCCTTGT
GGTCGTGCCACTGTTCGTCTGGAAAATGGGCCGGCTGCTCCAGTACTCCTGTTGCCCCGTGG
TGGTCCTCCCAGACACCTTGAAAATAACCAATTCACCCCAGAAGTTAATCAGCTGCAGAAGG
GAGGAGGTGGATGCCTGTGCCACGGCTGTGATGTCTCCTGAGGAACTCCTCAGGGCCTGGAT
CTCATAGGTTTGCGGAAGGGCCCAGGTGAAGCCGAGAACCTGGTCTGCATGACATGGAAACC
ATGAGGGGACAAGTTGTGTTTCTGTTTTCCGCCACGGACAAGGGATGAGAGAAGTAGGAAGA
GCCTGTTGTCTACAAGTCTAGAAGCAACCATCAGAGGCAGGGTGGTTTGTCTAACAGAACAC
TGACTGAGGCTTAGGGGATGTGACCTCTAGACTGGGGGCTGCCACTTGCTGGCTGAGCAACC
CTGGGAAAAGTGACTTCATCCCTTCGGTCCTAAGTTTTCTCATCTGTAATGGGGGAATTACC
TACACACCTGCTAAACACACACACACAGAGTCTCTCTCTATATATACACACGTACACATAAA
TACACCCAGCACTTGCAAGGCTAGAGGGAAACTGGTGACACTCTACAGTCTGACTGATTCAG
TGTTTCTGGAGAGCAGGACATAAATGTATGATGAGAATGATCAAGGACTCTACACACTGGGT
GGCTTGGAGAGCCCACTTTCCCAGAATAATCCTTGAGAGAAAAGGAATCATGGGAGCAATGG
TGTTGAGTTCACTTCAAGCCCAATGCCGGTGCAGAGGGAATGGCTTAGCGAGCTCTACAGT
AGGTGACCTGGAGGAAGGTCACAGCCACACTGAAAATGGGATGTGCATGAACACGGAGGATC
CATGAACTACTGTAAAGTGTTGACAGTGTGTGCACACTGCAGACAGCAGGTGAAATGTATGT
GTGCAATGCGACGAGAATGCAGAAGTCAGTAACATGTGCATGTTTGTTGTGCTCCTTTTTTC
TGTTGGTAAAGTACAGAATTCAGCAAATAAAAAGGGCCACCCTGGCCAAAAGCGGTAAAAAA
AAAAAAAAAA
```

FIGURE 32

MQTFTMVLEEIWTSLFMWFFYALIPCLLTDEVAILPAPQNLSVLSTNMKHLLMWSPVIAPGE
TVYYSVEYQGEYESLYTSHIWIPSSWCSLTEGPECDVTDDITATVPYNLRVRATLGSQTSAW
SILKHPFNRNSTILTRPGMEITKDGFHLVIELEDLGPQFEFLVAYWRREPGAEEHVKMVRSG
GIPVHLETMEPGAAYCVKAQTFVKAIGRYSAFSQTECVEVQGEAIPLVLALFAFVGFMLILV
VVPLFVWKMGRLLQYSCCPVVVLPDTLKITNSPQKLISCRREEVDACATAVMSPEELLRAWIS

Important features:

Signal peptide:

amino acids 1-29

Transmembrane domain:

amino acids 230-255

N-glycosylation sites.

amino acids 40-44, 134-138

Tissue factor proteins.

amino acids 92-120

Integrins alpha chain proteins.

amino acids 232-263

FIGURE 33

```
GAGACACGCGAGCGGGGAGACCTCCAAGGCAGCGAGGCATCGGACATGTGTCAGCACATCTG
GGGCGCACATCCGTCGAGCCCGAGGGGAGATTTGCCGGAACAATTCAAACTGCGATATTGAT
CTTGGGGGTGACTGTCCCTGGCCGGCTGTCGGGTGGGAGTGCGAGTGTGCACTCGCTCGGAA
GTGTGTGCGAGTGTGTATGTGTGTGCCGTGTCGGGCTCCCCCCTTCCCCCCGTTTTCCCG
TCGAGTGATGCACTTGGAATGAGAATCAGAGGATGGAAATAGTCTGGGAGGTGCTTTTTCTT
CTTCAAGCCAATTTCATCGTCTGCATATCAGCTCAACAGAATTCACCAAAAATCCATGAAGG
CTGGTGGGCATACAAGGAGGTGGTCCAGGGAAGCTTTGTTCCAGTTCCTTCTTTCTGGGAT
TGGTGAACTCAGCTTGGAATCTTTGCTCTGTGGGAAACGGCAGTCGCCAGTCAACATAGAG
ACCAGTCACATGATCTTCGACCCCTTTCTGACACCTCTTCGCATCAACACGGGGGGCAGGAA
GGTCAGTGGGACCATGTACAACACTGGAAGACACGTATCCCTTCGCCTGGACAAGGAGCACT
TGGTCAACATATCTGGAGGGCCCATGACATACAGCCACCGGCTGGAGGAGATCCGACTACAC
TTTGGGAGTGAGGACAGCCAAGGGTCGGAGCACCTCCTCAATGGACAGGCCTTCTCTGGGA
GGTGCAGCTCATCCACTATAACCATGAGCTATATACGAATGTCACAGAAGCTGCAAAGAGTC
CAAATGGATTGGTGGTAGTTTCTATATTTATAAAAGTTTCTGATTCATCAAACCCATTTCTT
AATCGAATGCTCAACAGAGATACTATCACAAGAATAACATATAAAAATGATGCATATTTACT
ACAGGGGCTTAATATAGAGGAACTATATCCAGAGACCTCTAGTTTCATCACTTACGATGGGT
CGATGACTATCCCACCCTGCTATGAGACAGCAAGTTGGATCATAATGAACAAACCTGTCTAT
ATAACCAGGATGCAGATGCATTCCTTGCGCCTGCTCAGCCAGAACCAGCCATCTCAGATCTT
TCTGAGCATGAGTGACAACTTCAGGCCTGTCCAGCCACTCAACAACCGCTGCATCCGCACCA
ATATCAACTTCAGTTTACAGGGGAAGGACTGTCCAAACAACCGAGCCCAGAAGCTTCAGTAT
AGAGTAAATGAATGGCTCCTCAAGTAGGGAACAAAGCCAAGAAGAATCCCACCTCAGTGAAA
TGCTACAACTGTGAATTGACGTAACCTAGAATGTCCCCCTTCTTGCTTCTCTCTCCTTCTTT
CCCCCAAGCCTCATTCATTCTTGGGATTGGCCCTTTCTTCATGAAAAGTGTCTGCGAAACCA
TGGCAGAGGAATACATCTCTCACACATACTCACAAACACACACACAAGCACTTGCACATACA
TACAAACACATGCAAACATACCTACACACACACACTCTCTTACAACCTCCATCATGGGAAGT
CAAGTTTCAGAAACAAAAGTCTCATTCATAAGAGGTCTTAGAAGAAAATAACCAGTTAACCT
GATTTCAATTTTGATACCGTTTTCCTGAACTAATAAATCTACCCAATGAGACTTTTCAGCCT
TTGTACATACAAAATTCTTCCAAAAGAGAGAGGAGAAAATACAGCTCTGATGGCATCAAACG
GACTTTGCATCAAGTAATTTCAGATAGTGTCCTAGGATCCTTTGAGGGTGCTGGTAGCAGGT
GAGCAGGACAAAGTTGACCAAGGACACTTATTTCTAGATTATGATTCTTCTGTTTACTCAAC
AATTTACAAAGAAAAAAGGACAGACATTGAAGAGCTACACATTGTATATATATCACCACAG
ACTATAAGGAAATGGAATTATTTCCCTCTTTGTCACATATCTGTAGTAGGATTTGCCAAGAT
CAGAAATGATCCATTTGCTGTTTCTTGTTTTCCAAAGGTCATACATTGTGTTTGGTTATTGT
TACCAGCTCAATAAATGTGTTTAACGAGTTAATTTCATTTTTCTGGCTTTGGTCTGTTCTCC
TTCCTTACAGGCTAAGCCCTGGCTCCATGCAACTGCATTCTTTGATTTCACTTGTTCCTTCA
TCTACATGTTTTGTTCATTTGCAGCCAGTTTTTACTGAGTTTGTGGCAATCAGGAATGCATT
TGCTAAGCAAGTATGACTTTAATTCCACTCCATGGCTCAATCATTCACATGAGGTGAGCTTC
AGCCTGAGATAGCAGGCGACAGACTTCTTGCGTTTCAAAACTGCCATGCCCCCTGTGATGC
TCCCGTGAAGGAATGCACTTTGCCTTGTAAGTTCCTGGGAAAGGGGTATGTTTTCTCTCCAG
GTGCAGCCAGATCTCACAAAGTACAAAACGAATGCCTTTCTTTTCTTGTTTATAATGGTCAC
TCACTGTGTTTGGTTACTGTCAAGAAATCAATAAATGTGTTTAACAAGTTA
```

FIGURE 34

MEIVWEVLFLLQANFIVCISAQQNSPKIHEGWWAYKEVVQGSFVPVPSFWGLVNSAWNLCSV
GKRQSPVNIETSHMIFDPFLTPLRINTGGRKVSGTMYNTGRHVSLRLDKEHLVNISGGPMTY
SHRLEEIRLHFGSEDSQGSEHLLNGQAFSGEVQLIHYNHELYTNVTEAAKSPNGLVVVSIFI
KVSDSSNPFLNRMLNRDTITRITYKNDAYLLQGLNIEELYPETSSFITYDGSMTIPPCYETA
SWIIMNKPVYITRMQMHSLRLLSQNQPSQIFLSMSDNFRPVQPLNNRCIRTNINFSLQGKDC
PNNRAQKLQYRVNEWLLK

Important features:

Signal peptide:
amino acids 1-20

Eukaryotic-type carbonic anhydrases proteins.
amino acids 126-162, 220-269, 43-91

N-glycosylation sites.
amino acids 116-119, 168-171, 302-305

FIGURE 35

```
GTCGGAACCCCCTCAGGCCACCCTCGGGAGTCCTGGGGTCCAGAGGGGTGTCCCTGTACCCCTTGCA
CACAGGACCCTCACTCTGCAGGGATAAGCCAGCTGCGCCTGCAGCCTAGGGTGCCAAGGAGGCTGCT
GATTGTGGCCCACAGCCTCATCTGAACGCCAGGAGACCAGGATACCGAGGCACCGGATCCCCTCTCT
GTGCCCTGGGGAGCCCCAGTGCTGCCCAGTCACCCCAGGGCTGAGGTCTGCGTCCCTAGTGGTGCAA
GGCCTGGTAGGACCACGGGGCAGGGAATGTGAGCGCCATCCGAGCTCACGGTGTCCTGAGTCGCGGC
TTCGTGACTTTGGCAGGGGCCTCCGGACCAGTGACCCCAGTCAAACCCAGAGGGTCTTGGGCGGCAG
CGACGAAGGAGGTATTCAGGCTCCAGGCCAGGTGGGCCGGACGCCCCAGCCATCCACCATGGTGG
TGGCACACCCCACCGCCACTGCCACCACCACGCCCACTGCCACTGTCACGGCCACCGTTGTGATGAC
CACGGCCACCATGGACCTGCGGGACTGGCTGTTCCTCTGCTACGGGCTCATCGCCTTCCTGACGGAG
GTCATCGACAGCACCACCTGCCCCTCGGTGTGCCGCTGCGACAACGGCTTCATCTACTGCAACGACC
GGGGACTCACATCCATCCCCGCAGATATCCCTGATGACGCCACCACCCTCTACCTGCAGAACAACCA
GATCAACAACGCCGGCATCCCCCAGGACCTCAAGACCAAGGTCAACGTGCAGGTCATCTACCTATAC
GAGAATGACCTGGATGAGTTCCCCATCAACCTGCCCCGCTCCCTCCGGGAGCTGCACCTGCAGGACA
ACAATGTGCGCACCATTGCCAGGGACTCGCTGGCCCGCATCCCGCTGCTGGAGAAGCTGCACCTGGA
TGACAACTCCGTGTCCACCGTCAGCATTGAGGAGGACGCCTTCGCCGACAGCAAACAGCTCAAGCTG
CTCTTCCTGAGCCGGAACCACCTGAGCAGCATCCCCTCGGGGCTGCCGCACACGCTGGAGGAGCTGC
GGCTGGATGACAACCGCATCTCCACCATCCCGCTGCATGCCTTCAAGGGCCTCAACAGCCTGCGGCG
CCTGGTGCTGGACGGTAACCTGCTGGCCAACCAGCGCATCGCCGACGACACCTTCAGCCGCCTACAG
AACCTCACAGAGCTCTCGCTGGTGCGCAATTCGCTGGCCGCGCCACCCCTCAACCTGCCCAGCGCCC
ACCTGCAGAAGCTCTACCTGCAGGACAATGCCATCAGCCACATCCCCTACAACACGCTGGCCAAGAT
GCGTGAGCTGGAGCGGCTGGACCTGTCCAACAACAACCTGACCACGCTGCCCCGCGGCCTGTTCGAC
GACCTGGGGAACCTGGCCCAGCTGCTGCTCAGGAACAACCCTTGGTTTTGTGGCTGCAACCTCATGT
GGCTGCGGGACTGGGTGAAGGCACGGGCGGCCGTGGTCAACGTGCGGGGCCTCATGTGCCAGGGCCC
TGAGAAGGTCCGGGGCATGGCCATCAAGGACATTACCAGCGAGATGGACGAGTGTTTTGAGACGGGG
CCGCAGGGCGGCGTGGCCAATGCGGCTGCCAAGACCACGGCCAGCAACCACGCCTCTGCCACCACGC
CCCAGGGTTCCCTGTTTACCCTCAAGGCCAAAAGGCCAGGGCTGCGCCTCCCCGACTCCAACATTGA
CTACCCCATGGCCACGGGTGATGGCGCCAAGACCCTGGCCATCCACGTGAAGGCCCTGACGGCAGAC
TCCATCCGCATCACGTGGAAGGCCACGCTCCCCGCCTCCTCTTTCCGGCTCAGTTGGCTGCGCCTGG
GCCACAGCCCAGCCGTGGGCTCCATCACGGAGACCTTGGTGCAGGGGACAAGACAGAGTACCTGCT
GACAGCCCTGGAGCCCAAGTCCACCTACATCATCTGCATGGTCACCATGGAGACCAGCAATGCCTAT
GTAGCTGATGAGACACCCGTGTGTGCCAAGGCAGAGACAGCCGACAGCTATGGCCCTACCACCACAC
TCAACCAGGAGCAGAACGCTGGCCCCATGGCGAGCCTGCCCCTGGCGGGCATCATCGGCGGGCAGT
GGCTCTGGTCTTCCTCTTCCTGGTCCTGGGGGCCATCTGCTGGTACGTGCACCAGGCTGGCGAGCTG
CTGACCCGGGAGAGGGCCTACAACCGGGGCAGCAGGAAAAAGGATGACTATATGGAGTCAGGGACCA
AGAAGGATAACTCCATCCTGGAAATCCGCGGCCCTGGGCTGCAGATGCTGCCCATCAACCCGTACCG
CGCCAAAGAGGAGTACGTGGTCCACACTATCTTCCCCTCCAACGGCAGCAGCCTCTGCAAGGCCACA
CACACCATTGGCTACGGCACCACGCGGGGCTACCGGGACGGCGGCATCCCCGACATAGACTACTCCT
ACACATGATGCCCGCCCACCCGGGCTGCCCCGCCTCAGCCCCAGCTGCCCTGGCGTGGCCATGTGGC
TTTGCCCAGCCTGCTGCAATCCAAGAGAGCAAGGAAGAGAAATTCCATGGGTGACTTTCCTCCGCAG
AAAGCAAAGTTTGGGGAGGGCTGACGATTTTGTAGAACACAACAGTGACAATTTTTTTTAAAAGAAT
AGAAGGCAGGAGGGGGAATTCGACATTGTTGAAGACATAATTTATACCAAGTTATGCCAGTTGGGGA
GGGAAGGACTAAAAATAATATTGCAGGCAGGGCTGGGTTGGGTTTTTTTTTTCCCCCCTGAACTGG
AAGGATACTACCTGTACAACATCTGTGGACACCTCATGCTCTGTTCAAGGCCATCACAAAGGAACCG
CCAGGGAGAAGCAGCCGGCTCTCAAAGCTCCCACGCAGCTCTCCCGCCACTGGCCACTCGCTGGCGA
CCCGATGGAAGGTTTTCAGGCTCCTCACAAAGGAGAGAGGGAAGAAAGATCTTTTGCCCTGGAGAT
ATGGTCCTGAAATCTCTCCCCTGGCTTATTCCATACCATTTCCCTTGCAGATTTGCAGAAACATGGC
ATCTTTCACTGCATTCTTTGAACAATCATGTAGTCGATTAAAAAAAAAAACAAACTTTTTTTTCCTA
GGCTGAAGCCCTCTTCAGTTCCATGCACCACGCTCCGTAGAAGCCCCGGCGGAAGCCGTAGCTTTCC
CTGCCACCTGGAGGTGCATCTGTCTGCCTGTCTATCCCTGTCGCGGTGTCTCTAAGTACAGATGGGT
AGATAGAGCCACATGCACGGTCCTTACCGTTCTTCTTGGGTCAGTTCTTACCATTTCCTGAACAATA
GAATTGTGAAAGTGTTAAAAA
```

FIGURE 36

```
MVVAHPTATATTTPTATVTATVVMTTATMDLRDWLFLCYGLIAFLTEVIDSTTCPSVCRCDN
GFIYCNDRGLTSIPADIPDDATTLYLQNNQINNAGIPQDLKTKVNVQVIYLYENDLDEFPIN
LPRSLRELHLQDNNVRTIARDSLARIPLLEKLHLDDNSVSTVSIEEDAFADSKQLKLLFLSR
NHLSSIPSGLPHTLEELRLDDNRISTIPLHAFKGLNSLRRLVLDGNLLANQRIADDTFSRLQ
NLTELSLVRNSLAAPPLNLPSAHLQKLYLQDNAISHIPYNTLAKMRELERLDLSNNNLTTLP
RGLFDDLGNLAQLLLRNNPWFCGCNLMWLRDWVKARAAVVNVRGLMCQGPEKVRGMAIKDIT
SEMDECFETGPQGGVANAAAKTTASNHASATTPQGSLFTLKAKRPGLRLPDSNIDYPMATGD
GAKTLAIHVKALTADSIRITWKATLPASSFRLSWLRLGHSPAVGSITETLVQGDKTEYLLTA
LEPKSTYIICMVTMETSNAYVADETPVCAKAETADSYGPTTTLNQEQNAGPMASLPLAGIIG
GAVALVFLFLVLGAICWYVHQAGELLTRERAYNRGSRKKDDYMESGTKKDNSILEIRGPGLQ
MLPINPYRAKEEYVVHTIFPSNGSSLCKATHTIGYGTTRGYRDGGIPDIDYSYT
```

Important features of the protein:

Transmembrane domain:

amino acids 552-573

N-glycosylation sites.

amino acids 249-252, 305-308, 642-645

Leucine zipper pattern.

amino acids 182-203, 299-320

Phospholipase A2 aspartic acid active site.

amino acids 57-67

FIGURE 37

```
GGTGACTGAAGCGAGCCTGGCCTCTTGCATCCTCCGCCTGTGTACCTCCCTCCCCTTTTTTTCCGCC
TTCTGCCAGCAGAAGCAGCAGCCGCAGCACCTGAGCCGCTACTGCCGCTCACTCAGGACAACGCTAT
GGCTGAGCCTGGGCACAGCCACCATCTCTCCGCCAGAGTCAGGAGAAGAACTGAGAGGCGCATACCC
CGGCTGTGGCGGCTGCTGCTCTGGGCTGGGACCGCCTTCCAGGTGACCCAGGGAACGGGACCGGAGC
TTCATGCCTGCAAAGAGTCTGAGTACCACTATGAGTACACGGCGTGTGACAGCACGGGTTCCAGGTG
GAGGGTCGCCGTGCCGCATACCCCGGGCCTGTGCACCAGCCTGTCTGACCCCGTCAAGGGCACCGAG
TGCTCCTTCTCCTGCAACGCCGGGGAGTTTCTGGATATGAAGGACCAGTCATGTAAGCCATGCGCTG
AGGGCCGCTACTCCCTCGGCACAGGCATTCGGTTTGATGAGTGGGATGAGCTGCCCCATGGCTTTGC
CAGCCTCTCAGCCAACATGGAGCTGGATGACAGTGCTGCTGAGTCCACCGGGAACTGTACTTCGTCC
AAGTGGGTTCCCCGGGGCGACTACATCGCCTCCAACACGGACGAATGCACAGCCACACTGATGTACG
CCGTCAACCTGAAGCAATCTGGCACCGTTAACTTCGAATACTACTATCCAGACTCCAGCATCATCTT
TGAGTTTTTCGTTCAGAATGACCAGTGCCAGCCCAATGCAGATGACTCCAGGTGGATGAAGACCACA
GAGAAAGGATGGGAATTCCACAGTGTGGAGCTAAATCGAGGCAATAATGTCCTCTATTGGAGAACCA
CAGCCTTCTCAGTATGGACCAAAGTACCCAAGCCTGTGCTGGTGAGAAACATTGCCATAACAGGGGT
GGCCTACACTTCAGAATGCTTCCCCTGCAAACCTGGCACGTATGCAGACAAGCAGGGCTCCTCTTTC
TGCAAACTTTGCCCAGCCAACTCTTATTCAAATAAAGGAGAAACTTCTTGCCACCAGTGTGACCCTG
ACAAATACTCAGAGAAAGGATCTTCTTCCTGTAACGTGCGCCCAGCTTGCACAGACAAAGATTATTT
CTACACACACGGCCTGCGATGCCAACGGAGAGACACAACTCATGTACAAATGGGCCAAGCCGAAA
ATCTGTAGCGAGGACCTTGAGGGGGCAGTGAAGCTGCCTGCCTCTGGTGTGAAGACCCACTGCCCAC
CCTGCAACCCAGGCTTCTTCAAAACCAACAACAGCACCTGCCAGCCCTGCCCATATGGTTCCTACTC
CAATGGCTCAGACTGTACCCGCTGCCCTGCAGGGACTGAACCTGCTGTGGGATTTGAATACAAATGG
TGGAACACGCTGCCCACAAACATGGAAACGACCGTTCTCAGTGGGATCAACTTCGAGTACAAGGGCA
TGACAGGCTGGGAGGTGGCTGGTGATCACATTTACACAGCTGCTGGAGCCTCAGACAATGACTTCAT
GATTCTCACTCTGGTTGTGCCAGGATTTAGACCTCCGCAGTCGGTGATGGCAGACACAGAGAATAAA
GAGGTGGCCAGAATCACATTTGTCTTTGAGACCCTCTGTTCTGTGAACTGTGAGCTCTACTTCATGG
TGGGTGTGAATTCTAGGACCAACACTCCTGTGGAGACGTGGAAAGGTTCCAAAGGCAAACAGTCCTA
TACCTACATCATTGAGGAGAACACTACCACGAGCTTCACCTGGGCCTTCCAGAGGACCACTTTTCAT
GAGGCAAGCAGGAAGTACACCAATGACGTTGCCAAGATCTACTCCATCAATGTCACCAATGTTATGA
ATGGCGTGGCCTCCTACTGCCGTCCCTGTGCCCTAGAAGCCTCTGATGTGGGCTCCTCCTGCACCTC
TTGTCCTGCTGGTTACTATATTGACCGAGATTCAGGAACCTGCCACTCCTGCCCCCCTAACACAATT
CTGAAAGCCCACCAGCCTTATGGTGTCCAGGCCTGTGTGCCCTGTGGTCCAGGGACCAAGAACAACA
AGATCCACTCTCTGTGCTACAATGATTGCACCTTCTCACGCAACACTCCAACCAGGACTTTCAACTA
CAACTTCTCCGCTTTGGCAAACACCGTCACTCTTGCTGGAGGGCAAGCTTCACTTCCAAAGGGTTG
AAATACTTCCATCACTTTACCCTCAGTCTCTGTGGAAACCAGGGTAGGAAAATGTCTGTGTGCACCG
ACAATGTCACTGACCTCCGGATTCCTGAGGGTGAGTCAGGGTTCTCCAAATCTATCACAGCCTACGT
CTGCCAGGCAGTCATCATCCCCCAGAGGTGACAGGCTACAAGGCCGGGGTTTCCTCACAGCCTGTC
AGCCTTGCTGATCGACTTATTGGGGTGACAACAGATATGACTCTGGATGGAATCACCTCCCCAGCTG
AACTTTTCCACCTGGAGTCCTTGGGAATACCGGACGTGATCTTCTTTTATAGGTCCAATGATGTGAC
CCAGTCCTGCAGTTCTGGGAGATCAACCACCATCCGCGTCAGGTGCAGTCCACAGAAAACTGTCCCT
GGAAGTTTGCTGCTGCCAGGAACGTGCTCAGATGGGACCTGTGATGGCTGCAACTTCCACTTCCTGT
GGGAGAGCGCGGCTGCTTGCCCGCTCTGCTCAGTGGCTGACTACCATGCTATCGTCAGCAGCTGTGT
GGCTGGGATCCAGANGACTACTTACGTGTGNCGAGAACCCAAGCTATGCTCTGGTGGCATTTCTCTG
CCTGAGCAGAGAGTCACCATCTGCAAAACCATAGATTTCTGGCTGAAAGTGGGCATCTCTGCAGGCA
CCTGTACTGCCATCCTGCTCACCGTCTTGACCTGCTACTTTTGGAAAAAGAATCAAAAACTAGAGTA
CAAGTACTCCAAGCTGGTGATGAATGCTACTCTCAAGGACTGTGACCTGCCAGCAGCTGACAGCTGC
GCCATCATGGAAGGCGAGGATGTAGAGGACGACCTCATCTTTACCAGCAAGAAGTCACTTTTTGGGA
AGATCAAATCATTTACCTCCAAGAGGACTCCTGATGGATTTGACTCAGTGCCGCTGAAGACATCCTC
AGGAGGCCCAGACATGGACCTGTGAGAGGCACTGCCTGCCTCACCTGCCTCCTCACCTTGCATAGCA
CCTTTGCAAGCCTGCGGCGATTTGGGTGCCAGCATCCTGCAACACCCACTGCTGGAAATCTCTTCAT
TGTGGCCTTATCAGATGTTTGAATTTCAGATCTTTTTTTATAGAGTACCCAAACCCTCCTTTCTGCT
TGCCTCAAACCTGCCAAATATCCCACATTTTTTTTAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAAAAAA
AAAAAAAAAAAAAAAA
```

FIGURE 38

```
MAEPGHSHHLSARVRRRTERRIPRLWRLLLWAGTAFQVTQGTGPELHACKESEYHYEYTACD
STGSRWRVAVPHTPGLCTSLSDPVKGTECSFSCNAGEFLDMKDQSCKPCAEGRYSLGTGIRF
DEWDELPHGFASLSANMELDDSAAESTGNCTSSKWVPRGDYIASNTDECTATLMYAVNLKQS
GTVNFEYYYPDSSIIFEFFVQNDQCQPNADDSRWMKTTEKGWEFHSVELNRGNNVLYWRTTA
FSVWTKVPKPVLVRNIAITGVAYTSECFPCKPGTYADKQGSSFCKLCPANSYSNKGETSCHQ
CDPDKYSEKGSSSCNVRPACTDKDYFYTHTACDANGETQLMYKWAKPKICSEDLEGAVKLPA
SGVKTHCPPCNPGFFKTNNSTCQPCPYGSYSNGSDCTRCPAGTEPAVGFEYKWWNTLPTNME
TTVLSGINFEYKGMTGWEVAGDHIYTAAGASDNDFMILTLVVPGFRPPQSVMADTENKEVAR
ITFVFETLCSVNCELYFMVGVNSRTNTPVETWKGSKGKQSYTYIIEENTTTSFTWAFQRTTF
HEASRKYTNDVAKIYSINVTNVMNGVASYCRPCALEASDVGSSCTSCPAGYYIDRDSGTCHS
CPPNTILKAHQPYGVQACVPCGPGTKNNKIHSLCYNDCTFSRNTPTRTFNYNFSALANTVTL
AGGPSFTSKGLKYFHHFTLSLCGNQGRKMSVCTDNVTDLRIPEGESGFSKSITAYVCQAVII
PPEVTGYKAGVSSQPVSLADRLIGVTTDMTLDGITSPAELFHLESLGIPDVIFFYRSNDVTQ
SCSSGRSTTIRVRCSPQKTVPGSLLLPGTCSDGTCDGCNFHFLWESAAACPLCSVADYHAIV
SSCVAGIQXTTYVXREPKLCSGGISLPEQRVTICKTIDFWLKVGISAGTCTAILLTVLTCYF
WKKNQKLEYKYSKLVMNATLKDCDLPAADSCAIMEGEDVEDDLIFTSKKSLFGKIKSFTSKR
TPDGFDSVPLKTSSGGPDMDL
```

Important features of the protein:

N-glycosylation sites:

amino acids 153-156, 390-393, 391-394, 404-407, 544-547, 576-579, 672-675, 717-720, 947-950 cAMP- and cGMP-dependent protein kinase phosphorylation sites:

amino acids 15-18, 563-566, 709-712

Casein kinase II phosphorylation sites:

amino acids 42-45, 59-62, 81-84, 146-149, 168-171, 282-285, 331-334, 340-343, 431-434, 449-452, 465-468, 523-526, 557-560, 761-764, 780-783, 835-838, 860-863, 893-896, 949-952

Tyrosine kinase phosphorylation sites:

amino acids 50-56, 109-116

N-myristoylation sites:

amino acids 77-82, 88-93, 152-157, 268-273, 288-293, 320-325, 400-405, 405-410, 414-419, 463-468, 599-604, 616-621, 634-639, 644-649, 839-844, 874-879, 912-917, 916-921

Amidation site:

amino acids 707-710

Cell attachment sequence:

amino acids 162-164

FIGURE 39

```
GGGAAGGGGTTCTGGGCTGCCGCAGGCACACAGGCCAGAGCTTCGTGGATACCTGCAGGGCC
CAAAGGTCCCTCCCTGTTTTGAAGAGTGAGTGATGGCTATGAGGTAGCGGCCAGGCTGATCA
CCCCTGCGTTGGCTGGAGGCAGAATTCTGTAAATCCTCGCCAAGTCTTTCTCCAGGCCACTG
GTTAGCTCATCTCAGCCTCCTCTGGGAGCATCAACACCAACATGGCACAGGGGACTGCAGTG
GTGTGCTTTGGACCTGTGTACCCACCCAAGGCTAAAGGCAGAGCCAGGTGACTTTGCGGGG
TCTCTTCTCTAGGATTATCTGTACTTCCCCTCTGTCCTCTTTTACTACGGGAGATCGAGCTA
GCTATAACCCACCTTCTTTCATGAGAACCACACTAAATTGCAAAAATTATCCCAGTGCTGGA
GGAGGGCAGCAGGTTGAGATTATGTTGGCAGGAAGAATGTTGGCATTGATTGGCACGCAGGG
GACGAGAGCTGCTTTGTGCTTTAAAGGAGCCAAGTTACACCCTGTTTAACCCTGCCTTCAAA
GGGACGACTCTGTAAGATTCTCTGCTACTTATTCAAGTTGACACGATGCCCTTCACACTCCA
CCTGAGGTCCCGCCTTCCCTCTGCCATAAGGAGTTTGATTCTACAAAAGAAACCAAACATCA
GAAATACATCCAGCATGGCTGGAGAGCTCCGACCAGCCAGCCTGGTGGTCCTGCCCAGGTCC
CTTGCTCCAGCTTTTGAAAGATTCTGCCAGGTCAACACTGGTCCTCTACCCCTGCTGGGCCA
GAGTGAGCCAGAAAAGTGGATGCTGCCCCCTCAAGGTGCTATCTCAGAGACCAGGATGGGCC
ATCCCCAGTTCTGGAAATACGAGTTCGGTGCCTGCACCGGTAGCCTGGCTTCGCTGGAGCAG
TACTCGGAGCAGCTGAAGGACATGGTGGCCTTCTTCCTGGGCTGCAGCTTCTCCCTGGAGGA
GGCCTTGGAGAAAGCGGGGCTCCCCAGAAGAGACCCAGCAGGTCACAGCCAGGCGGGTGCAT
ACAAGACAACAGTGCCTTGTGTTACCCATGCTGGCTTCTGCTGCCCTCTGGTGGTCACGATG
AGGCCCATTCCCAAGGACAAGCTGGAAGGGCTGGTGCGGGCCTGCTGCTCCCTCGGAGGTGA
GCAGGGGCAACCTGTTCACATGGGCGACCCAGAACTGTTGGGAATCAAAGAGCTTTCCAAAC
CTGCCTACGGGGATGCCATGGTGTGTCCCCAGGGGAGGTTCCAGTGTTCTGGCCTTCTCCG
CTGACCAGTCTCGGAGCTGTCAGCAGCTGTGAGACCCCACTGGCTTTTGCCAGCATCCCAGG
CTGCACAGTTATGACTGACCTGAAGGATGCAAAGGCTCCACCTGGTTGTCTCACCCCAGAGA
GAATTCCAGAGGTCCATCACATTTCCCAAGATCCTCTGCACTACAGCATCGCGTCAGTCTCT
GCTTCTCAGAAGATCAGAGAACTAGAGTCTATGATCGGCATAGACCCAGGGAACCGGGGGAT
TGGGCACCTGCTCTGTAAAGATGAGCTGCTGAAGGCCTCTCTCTCGCTGTCCATGCCCGCT
CAGTGCTCATCACCACTGGGTTCCCCACACATTTCAATCATGAGCCTCCAGAAGAGACAGAT
GGCCCACCAGGAGCTGTTGCTCTGGTTGCCTTCCTGCAGGCCTTGGAGAAGGAGGTCGCCAT
AATCGTTGACCAGAGAGCCTGGAACTTGCACCAGAAGATTGTTGAAGATGCTGTTGAGCAAG
GTGTTCTGAAGACGCAGATCCCGATATTAACTTACCAAGGTGGATCAGTGGAAGCTGCTCAG
GCATTCCTGTGCAAAAATGGGGACCCGCAGACACCTAGATTTGACCACCTGGTGGCCATAGA
GCGTGCCGGAAGAGCTGCTGATGGCAATTACTACAATGCAAGGAAGATGAACATCAAGCACT
TGGTTGACCCCATTGACGATCTTTTTCTTGCTGCGAAGAAGATTCCTGGAATCTCATCAACT
GGAGTCGGTGATGGAGGCAACGAGCTTGGGATGGGTAAAGTCAAGGAGGCTGTGAGGAGGCA
CATACGGCACGGGGATGTCATCGCCTGCGACGTGGAGGCTGACTTTGCCGTCATTGCTGGTG
TTTCTAACTGGGGAGGCTATGCCCTGGCCTGCGCACTCTACATCCTGTACTCATGTGCTGTC
CACAGTCAGTACCTGAGGAAAGCAGTCGGACCCTCCAGGGCACCTGGAGATCAGGCCTGGAC
TCAGGCCCTCCCGTCGGTCATTAAGGAAGAAAAAATGCTGGGCATCTTGGTGCAGCACAAAG
TCCGGAGTGGCGTCTCGGGCATCGTGGGCATGGAGGTGGATGGGCTGCCCTTCCACAACACC
CACGCCGAGATGATCCAGAAGCTGGTGGACGTCACCACGGCACAGGTGTAACCGTCCATGTT
CCGTGTGAGCAGAGTCCCTACCAACGGGCAGGTCTGCATCCGGGGAGAATGCAGCTGCTTCT
GGCGACAATCCTGCTAGTAAACACTGGTCTTCGGTGAGCAACGAACACTCGCCTGGCCTGGG
AAACTGCATGCCCACTTTCTGGGAGGGGTTAGTGCAGGTGCCGTGGACAAAGGACAACATTT
CTCTGGGGCTTTTTAACTTTTATTCCTAAGACTCTAAAGGCGTTGATTTCAACCCTCCTTCA
CTCTGGCTTCTTCAGGCAACCCACGTGGTCTCCTATGAGAATCTTCTCGACAGTTACTTATG
GGGACACTTGTGAACAATTAACTGCCAGGGCAGAGCATGAGAACAAACATTCCCAGGCCATG
TAGGATAGGATACTCCAGACTCCAGTCATCCTCCCCCATCCATGGTTTCTGTTACTCATGGT
TTCAGTTACTCATAGCCAACTGCAGACCGAAAATACTAAATGAAAAATTTCAGAAATAAACA
ACTCTTAAGTTTTAAAAAAAAA
```

FIGURE 40

```
MPFTLHLRSRLPSAIRSLILQKKPNIRNTSSMAGELRPASLVVLPRSLAPAFERFCQVNTGP
LPLLGQSEPEKWMLPPQGAISETRMGHPQFWKYEFGACTGSLASLEQYSEQLKDMVAFFLGC
SFSLEEALEKAGLPRRDPAGHSQAGAYKTTVPCVTHAGFCCPLVVTMRPIPKDKLEGLVRAC
CSLGGEQGQPVHMGDPELLGIKELSKPAYGDAMVCPPGEVPVFWPSPLTSLGAVSSCETPLA
FASIPGCTVMTDLKDAKAPPGCLTPERIPEVHHISQDPLHYSIASVSASQKIRELESMIGID
PGNRGIGHLLCKDELLKASLSLSHARSVLITTGFPTHFNHEPPEETDGPPGAVALVAFLQAL
EKEVAIIVDQRAWNLHQKIVEDAVEQGVLKTQIPILTYQGGSVEAAQAFLCKNGDPQTPRFD
HLVAIERAGRAADGNYYNARKMNIKHLVDPIDDLFLAAKKIPGISSTGVGDGGNELGMGKVK
EAVRRHIRHGDVIACDVEADFAVIAGVSNWGGYALACALYILYSCAVHSQYLRKAVGPSRAP
GDQAWTQALPSVIKEEKMLGILVQHKVRSGVSGIVGMEVDGLPFHNTHAEMIQKLVDVTTAQV
```

Signal peptide:

amino acids 1-17

Transmembrane domain:

amino acids 358-378, 517-539

N-glycosylation site.

amino acids 28-32

Tyrosine kinase phosphorylation site.

amino acids 444-452

N-myristoylation site.

amino acids 98-104, 102-108, 123-129, 149-155, 181-187, 190-196, 238-244, 308-314, 399-405, 413-419, 448-454, 477-483, 482-488, 487-493

Prokaryotic membrane lipoprotein lipid attachment site.

amino acids 233-244, 531-542

FIGURE 41

CTTTCCTGTTTTATCCGCAGCCCTTTTCTTCTTTGAGTTAGTAAAGATTTATTCTGTAACCT
GACACTCATCTGGCCCTTTGCAGTTTGCCAGCCATATTCCCATGTGATTTCCCACTGGATCC
AGGCCCCCATCCGGCTGGCAGGAGGGGGCTCTGACGTACAGGTTGGAAATCAGAAGTCTGTG
AGAGCGCGGGAGTGCATGGCAGCTCTGGGTCCCAGACCTGGCCCGACCCCTCTGCTTCACCT
CCAGCTCTGCTGCTCCTCTACTCTTGGGTCGAGATCCCTTTGGAGCCACAGCGAGGAACCCT
GTGGTCCTCAGGCAGGTGTACCTTGAGTCAGCCAGGAGCCCTCTTTTCCTGTGTCAAAGCCT
GCCCTCGGGCTCTGCTCACCTCTGGTGACCCTCCAAGATGCCCCTGCCCTCAGTTTCCCCTC
ATGATCTGGCCTCTGCCCCCTTCTCTAGCCACAGCCTCTAGTACACTTTAGCAATACCACCA
GACTAGTTAGAGTTCCCCACTCACCAAGCAAGACATGCAGTTTCATGCCTCTGTGCCTTCGC
TCATGCTGTTTCTTCCGACTGGAATGCCTTCCCCTGCTCCTCCTGCCTTGTCTGCCTGGCAA
GTTCATCTCTCACGATCCCCTCAAAGGCCCCCTCCTCCAGGAAGGCAACCCCTGTGCCCCTC
CCCTCCAGGCTACCTCTGCACTTTGTCAATGCTTCTCTTGTGGCACTTATCACACTGTATTT
TACTTGTTTACATGTTTGTCTCCCCTTCTAGACTGTGAATCCTTAAGGGCATGGACTGTATC
TTATGCATCTCTGTATTTCTGCGCCTAGCACGGTGCCTAGCACACAGTAGGCGCTCAATAAA
TGTTGAATGAATGAATGATTT

FIGURE 42

MQFHASVPSLMLFLPTGMPSPAPPALSAWQVHLSRSPQRPPPPGRQPLCPSPPGYLCTLSML
LLWHLSHCILLVYMFVSPSRL

Important features of the protein:

Signal peptide:

amino acids 1-22

Microbodies C-terminal targeting signal.

amino acids 81-83

FIGURE 43

```
GTTTCCAACAAGGATGATATGAAGACTTCCCTGAAGAAAGTTGTGAAGGGACCTCCTACGAG
ATGATGATGCAGTGTGTGTCCCGCATGTTGGCCCACCCCCTGCATGTCATCTCAATGCGCTG
CATGGTCCAGTTTGTGGGACGGGAGGCCAAGTACAGTGGTGTGCTGAGCTCCATTGGGAAGA
TTTTCAAAGAGGAAGGGCTGCTGGGATTCTTCGTTGGATTAATCCCTCACCTCCTGGGCGAT
GTGGTTTTCTTGTGGGGCTGTAACCTGCTGGCCCACTTCATCAATGCCTACCTGGTGGATGA
CAGCTTCAGCCAGGCCCTGGCCATCCGGAGCTATACCAAGTTCGTGATGGGGATTGCAGTGA
GCATGCTGACCTACCCCTTCCTGCTAGTTGGCGACCTCATGGCTGTGAACAACTGCGGGCTG
CAAGCTGGGCTCCCCCCTTACTCCCAGTGTTCAAATCCTGGATTCACTGCTGGAAGTACCT
GAGTGTGCAGGGCCAGCTCTTCCGAGGCTCCAGCCTGCTTTTCCGCCGGGTGTCATCAGGAT
CATGCTTTGCCCTGGAGTAACCTGAATCATCTAAAAAACACGGTCTCAACCTGGCCACTGTG
GGTGAGGCCTGACCACCTTGGGACACCTGCAAGACGACTCCAACCCAACAACAACCAGATGT
GCTCCAGCCCAGCCGGGCTTCAGTTCCATATTTGCCATGTGTCTGTCCAGATGTGGGGTTGA
GCGGGGGTGGGGCTGCACCCAGTGGATTGGGTCACCCGGCAGACCTAGGGAAGGTGAGGCGA
GGTGGGGAGTTGGCAGAATCCCCATACCTCGCAGATTTGCTGAGTCTGTCTTGTGCAGAGGG
CCAGAGAATGGCTTATGGGGGCCCAGGTTGGATGGGGAAAGGCTAATGGGGTCAGACCCCAC
CCCGTCTACCCCTCCAGTCAGCCCAGCGCCCATCCTGCAGCTCAGCTGGGAGCATCATTCTC
CTGCTTTGTACATAGGGTGTGGTCCCCTGGCACGTGGCCACCATCATGTCTAGGCCTATGCT
AGGAGGCAAATGGCCAGGCTCTGCCTGTGTTTTTCTCAACACTACTTTTCTGATATGAGGGC
AGCACCTGCCTCTGAATGGGAAATCATGCAACTACTCAGAATGTGTCCTCCTCATCTAATGC
TCATCTGTTTAATGGTGATGCCTCGCGTACAGGATCTGGTTACCTGTGCAGTTGTGAATACC
CAGAGGTTGGGCAGATCAGTGTCTCTAGTCCTACCCAGTTTTAAAGTTCATGGTAAGATTTG
ACCTCATCTCCCGCAAATAAATGTATTGGTGATTTGGAAAAAAAAAAAAAAAAA
```

FIGURE 44

MMMQCVSRMLAHPLHVISMRCMVQFVGREAKYSGVLSSIGKIFKEEGLLGFFVGLIPHLLGD
VVFLWGCNLLAHFINAYLVDDSFSQALAIRSYTKFVMGIAVSMLTYPFLLVGDLMAVNNCGL
QAGLPPYSPVFKSWIHCWKYLSVQGQLFRGSSLLFRRVSSGSCFALE

Important features of the protein:

Signal peptide:

amino acids 1-18

Transmembrane domains:

amino acids 51-72, 97-114 cAMP- and cGMP-dependent protein kinase phosphorylation site.

amino acids 160-163

N-myristoylation sites.

amino acids 34-39, 100-105, 123-128, 165-170

FIGURE 45

```
GCTCACTCTTTGGGTCCACACTGCCTTTATGAGCTGTAACACTCACTGGGAATGTCTGCAGC
TTCACTCCTGAAGCCAGCGAGACCACGAACCCACCAGGAGGAACAAACAACTCCAGACGCGC
AGCCTTAAGAGCTGTAACACTCACCGCGAAGGTCTGCAGCTTCACTCCTGAGCCAGCCAGAC
CACGAACCCACCAGAAGGAAGAAACTCCAAACACATCCGAACATCAGAAGGAGCAAACTCGT
GACACGCCACCTTTAAGAACCGTGACACTCAACGCTAGGGTCCGCGGCTTCATTCTTGAAGT
CAGTGAGACCAAGAACCCACCAATTCCGGACACGGCAAAGTAACATCCTAGACATGGCTTTA
GAGATCCACATGTCAGACCCCATGTGCCTCATCGAGAACTTTAATGAGCAGCTGAAGGTTAA
TCAGGAAGCTTTGGAGATCCTGTCTGCCATTACGCAACCTGTAGTTGTGGTAGCGATTGTGG
GCCTCTATCGCACTGGCAAATCCTACCTGATGAACAAGCTGGCTGGGAAGAACAAGGGCTTC
TCTGTTGCATCTACGGTGCAGTCTCACACCAAGGGAATTTGGATATGGTGTGTGCCTCATCC
CAACTGGCCAAATCACACATTAGTTCTGCTTGACACCGAGGGCCTGGGAGATGTAGAGAAGG
CTGACAACAAGAATGATATCCAGATCTTTGCACTGGCACTCTTACTGAGCAGCACCTTTGTG
TACAATACTGTGAACAAAATTGATCAGGGTGCTATCGACCTACTGCACAATGTGACAGAACT
GACAGATCTGCTCAAGGCAAGAAACTCACCTGACCTTGACAGGGTTGAAGATCCTGCTGACT
CTGCGAGCTTCTTCCCAGACTTAGTGTGGACTCTGAGAGATTTCTGCTTAGGCCTGGAAATA
GATGGGCAACTTGTCACACCAGATGAATACCTGGAGAATTCCCTAAGGCCAAAGCAAGGTAG
TGATCAAGAGTTCAAAATTTCAATTTGCCCCGTCTGTGTATACAGAAGTTCTTTCCAAAAA
AGAAATGCTTTATCTTTGACTTACCTGCTCACCAAAAAAGCTTGCCCAACTTGAAACACTG
CCTGATGATGAGCTAGAGCCTGAATTTGTGCAACAAGTGACAGAATTCTGTTCCTACATCTT
TAGCCATTCTATGACCAAGACTCTTCCAGGTGGCATCATGGTCAATGGATCTCGTCTAAAGA
ACCTGGTGCTGACCTATGTCAATGCCATCAGCAGTGGGGATCTGCCTTGCATAGAGAATGCA
GTCCTGGCCTTGGCTCAGAGAGAGAACTCAGCTGCAGTGCAAAAGGCCATTGCCCACTATGA
CCAGCAAATGGGCCAGAAAGTGCAGCTGCCCATGGAAACCCTCCAGGAGCTGCTGGACCTGC
ACAGGACCAGTGAGAGGGAGGCCATTGAAGTCTTCATGAAAAACTCTTTCAAGGATGTAGAC
CAAAGTTTCCAGAAAGAATTGGAGACTCTACTAGATGCAAAACAGAATGACATTTGTAAACG
GAACCTGGAAGCATCCTCGGATTATTGCTCGGCTTTACTTAAGGATATTTTGGTCCTCTAG
AAGAAGCAGTGAAGCAGGGAATTTATTCTAAGCCAGGAGGCCATAATCTCTTCATTCAGAAA
ACAGAAGAACTGAAGGCAAAGTACTATCGGGAGCCTCGGAAAGGAATACAGGCTGAAGAAGT
TCTGCAGAAATATTTAAAGTCCAAGGAGTCTGTGAGTCATGCAATATTACAGACTGACCAGG
CTCTCACAGAGACGGAAAAAAGAAGAAAGAGGCACAAGTGAAAGCAGAAGCTGAAAAGGCT
GAAGCGCAAAGGTTGGCGGCGATTCAAAGGCAGAACGAGCAAATGATGCAGGAGAGGGAGAG
ACTCCATCAGGAACAAGTGAGACAAATGGAGATAGCCAAACAAAATTGGCTGGCAGAGCAAC
AGAAAATGCAGGAACAACAGATGCAGGAACAGGCTGCACAGCTCAGCACAACATTCCAAGCT
CAAAATAGAAGCCTTCTCAGTGAGCTCCAGCACGCCCAGAGGGCTGTTAATAACGATGATCC
ATGTGTTTTACTCTAAAGTGCTAAATATGGGAGTTTCCTTTTTTTACTCTTTGTCACTGATG
ACACAACAGAAAAGAAACTGTAGACCTTGGGACAATCAACATTTAAATAAACTTTATAATTA
TTAAA
```

FIGURE 46

MALEIHMSDPMCLIENFNEQLKVNQEALEILSAITQPVVVVAIVGLYRTGKSYLMNKLAGKN
KGFSVASTVQSHTKGIWIWCVPHPNWPNHTLVLLDTEGLGDVEKADNKNDIQIFALALLLSS
TFVYNTVNKIDQGAIDLLHNVTELTDLLKARNSPDLDRVEDPADSASFFPDLVWTLRDFCLG
LEIDGQLVTPDEYLENSLRPKQGSDQRVQNFNLPRLCIQKFFPKKKCFIFDLPAHQKKLAQL
ETLPDDELEPEFVQQVTEFCSYIFSHSMTKTLPGGIMVNGSRLKNLVLTYVNAISSGDLPCI
ENAVLALAQRENSAAVQKAIAHYDQQMGQKVQLPMETLQELLDLHRTSEREAIEVFMKNSFK
DVDQSFQKELETLLDAKQNDICKRNLEASSDYCSALLKDIFGPLEEAVKQGIYSKPGGHNLF
IQKTEELKAKYYREPRKGIQAEEVLQKYLKSKESVSHAILQTDQALTETEKKKKEAQVKAEA
EKAEAQRLAAIQRQNEQMMQERERLHQEQVRQMEIAKQNWLAEQQKMQEQQMQEQAAQLSTT
FQAQNRSLLSELQHAQRAVNNDDPCVLL

Important features of the protein:

Transmembrane domains:
amino acids 31-49, 114-131

N-glycosylation sites.
amino acids 90-94, 144-148, 287-291, 563-567

N-myristoylation sites.
amino acids 45-51, 283-289

Prenyl group binding site.
amino acids 583-588

ATP/GTP-binding site motif A (P-loop).
amino acids 45-53

FIGURE 47

CACTCATTCATTCCAAAGGGTCTCTCAAGGCAATGGTAATGTGCAAGGAGGTGATACCTAAA
TGAATGACCAAAAGAACATGCTTCTGCTTTTGTGTGTCTCCTACATTTTAGACATTTGTTTG
TTTCTCTTGGTAGCCTTTAAATTCCTTGAAGCCCAGGACCATGTCTCACTTACCTTTGTGTT
TCCACTAACTAGTCTACCTCCTGGAATTGGCAGATACTCAGTGAAAGCCTGTGAAATAAGTG
ATGTCTATTTCTAGCATATTATTCTGAGATTTAATGATAGATTTAGTGATTGAATGAGATTT
CCATTTTCAAATACAGCAAAAGCATAACTATTTTCATTCATTCATATTCATTCAACTTCATT
CTCAAAATTAGGTCCTGAGTTAACTAATAATTACCTTTGAAATGTGTGGGTTATTTGAGGCA
ATCAGGTGGTGACATTGAGCTCTCAGCCAGAGTTTGTTTCTGGAATTGATTCAGTTCCATTG
CATTGATTTTGTTCTCAGAAGCCAAGGTTTCCCATGAAAAATCATTCCCACTTGAATTGGG
CTGTGATTCTTGCTGCGTTTAAGTAAAGGAAGCCTCTTGGTTCTAGTTCTGCAAACTTACAC
ACTGAACTGGGACAAGTTTTTGTTTAGAGTAATGGCTGGGAAAAGAGGAACCTTTCATTTTA
TTCAGAAGTCAAAAACAAAGGCCTCCCAGCCACCTGGAGATGTTTTGTTGCAGACACCAGCC
TGGCTCTGTCTTTATGCCTAACAATTGAGCATCCAGTCTTCTTTGTGCTGGGACCATTGCTC
AGCTCTGCAAGGGGAAAAGAGGGAGAAAGCCAGAGCTGCCAGGCTTCTTGCACTGGGGCCGG
GGGAGGGTTCCTGGGAAGCAGGTGCTCTCTGGCTTCTTGGTACGTGAGGCTCTCGGAGCTGC
CTCTCCTCTGACCCTCAGGTCCTCACCGAGTTTGCTCCAGGAGTATATTGAAAACATACCCA
GTGCTCTCTCAAGCACCCACTGCTTAGAGGGCCCAGATTTCTTTTCCTTCTTTCCCTTGCAG
AGCTGGAGACTGCATCGGGCATCTGGTGTTTAAACTAAACAGGAAAACTGACTAAAGGTCCA
CAGTGCTCATTGTGTAGACTAGCTGCCCTCC<u>ATG</u>GGTGCTCTGATTATCAGTGGTTCCAGT
GCAGGGCCTGTCACTAAACAGGCCTCACTTCCTCCTTGGGGGCTTTCCCATGGGAGGTGTGG
CTTTTTACTCTACATGGAAATGACTCTCTGCAGCCACAGAACACAGTCATTTCTGAATTAT
CCCAGTCTCTCATGCGCCCTGGATTCCTCCAGATGCCTTATATCTCTTGTGCAAAGTTGTCT
AAAATTTGGTTCCCAGCTTCCAAGCCTTGCCTTTTGGCCTTCCTGGAAGTATTTTTGTTGAT
GAGTCGTCTGTCATTATTCTCTAAAATGATTTGCTTTTTGTTTCTTTCATTCCTATTTCCAC
CCCACATATACACACATGCTTCT<u>TAA</u>CTTAGGGGATTACATGCCAATAAATCTATTGTTGAA
AATGCACTAATACTATCGCAAAGACGAAAATTCACAGGCTGAACCGTTGTAAGTCCATATGC
TCCTCAACTTACATGTGTGATGGAGTTATGCCCAAATAAGTCCATCGTCAAGTTGAAAAATC
AAAATCAAGCCATCTTAGGTTGAGGACCATTTGTTTGTACCTCCAAAGATGTCATATCTTTA
AACATACTCCCTAGCTTTTCTTTTTACTTTTTATTTTGAAGTAATTATAGAATCACAGAAAG
TTGCAAAAAA

FIGURE 48

MGALIISGSSAGPVTKQASLPPWGLSHGRCGFLLYMEMTLCSHRTQSFSELSQSLMRPGFLQ
MPYISCAKLSKIWFPASKPCLLAFLEVFLLMSRLSLFSKMICFLFLSFLFPPHIYTHAS

Important features of the protein:

Signal peptide:

amino acids 1-41

Transmembrane domain:

amino acids 88-107

Casein kinase II phosphorylation site.

amino acids 47-50

N-myristoylation site.

amino acids 24-29

FIGURE 49

```
GGCTTCTACAGTCCACAACACCCACCAGCCCCAGGCCCAGCAGAATGAGCCCAGTGAGTGCCGGGGCTCCCAGT
TTGGCTGTTGCTATGACAACGTGGCCACTGCAGCCGGTCCTCTTGGGGAAGGCTGTGTGGGCCAGCCCAGCCAT
GCCTACCCCGTGCGGTGCCTGCTGCCCAGTGCCCATGGCTCTTGTGCAGACTGGGCTGCCCGCTGGTACTTCGT
TGCCTCTGTGGGCCAATGTAACCGCTTCTGGTATGGCGGCTGCCATGGCAATGCCAATAACTTTGCCTCGGAGC
AAGAGTGCATGAGCAGCTGCCAGGGATCTCTCCATGGGCCCCGTCGTCCCCAGCCTGGGGCTTCTGGAAGGAGC
ACCCACACGGATGGTGGCGGCAGCAGTCCTGCAGGCGAGCAGGAACCCAGCCAGCACAGGACAGGGGCCGCGGT
GCAGAGAAAGCCCTGGCCTTCTGGTGGTCTCTGGCGGCAAGACCAACAGCCTGGGCCAGGGGAGGCCCCCCACA
CCCAGGCCTTTGGAGAATGGCCATGGGGCAGGAGCTTGGGTCCAGGGCCCCTGGACTGGGTGGAGATGCCGGA
TCACCAGCGCCACCCTTCCACAGCTCCTCCTACAGATCTCACTTCCCACCTCTCCAGGATTAGCTTGGCAGGTG
TGGAGCCCTCGTTGGTGCAGGCAGCCCTGGGGCAGTTGGTGCGGCTCTCCTGCTCAGACGACACTGCCCCGGAA
TCCCAGGCTGCCTGGCAGAAAGATGGCCAGCCCATCTCCTCTGACAGGCACAGGCTGCAGTTCGACGGATCCCT
GATCATCCACCCCTGCAGGCAGAGGACGCGGGCACCTACAGCTGTGGCAGCACCCGGCCAGGCCGCGACTCCC
AGAAGATCCAACTCCGCATTATAGGGGGTGACATGGCCGTGCTGTCTGAGGCTGAGCTGAGCCGCTTCCCTCAG
CCCAGGGACCCAGCTCAGGACTTTGGCCAAGCGGGGCTGCTGGGCCCCTGGGGGCCATCCCCTCTTCACACCC
ACAGCCTGCAAACAGGCTGCGTTTGGACCAGAACCAGCCCCGGGTGGTGGATGCCAGTCCAGGCCAGCGGATCC
GGATGACCTGCCGTGCCGAAGGCTTCCCGCCCCCAGCCATCGAGTGGCAGAGAGATGGGCAGCCTGTCTCTTCT
CCCAGACACCAGCTGCAGCCTGATGGCTCCCTGGTCATTAGCCGAGTGGCTGTAGAAGATGGCGGCTTCTACAC
CTGTGTCGCTTTCAATGGGCAGGACCGAGACCAGCGATGGGTCCAGCTCAGAGTTCTGGGGGAGCTGACAATCT
CAGGACTGCCCCCTACTGTGACAGTGCCAGAGGGTGATACGGCCAGGCTATTGTGTGTGGTAGCAGGAGAAAGT
GTGAACATCAGGTGGTCCAGGAACGGGCTACCTGTGCAGGCTGATGGCCACCGTGTCCACCAGTCCCCAGATGG
CACGCTGCTCATTTACAACTTGCGGGCCAGGGATGAGGGCTCCTACATGTGCAGTGCCTACCAGGGGAGCCAGG
CAGTCAGCCGCAGCACCGAGGTGAAGGTGGTCTCACCAGCACCCACCGCCCAGCCCAGGGACCCTGGCAGGGAC
TGCGTCGACCAGCCAGAGCTGGCCAACTGTGATTTGATCCTGCAGGCCCAGCTTTGTGGCAATGAGTATTACTC
CAGCTTCTGCTGTGCCAGCTGTTCACGTTTCCAGCCTCACGCTCAGCCCATCTGGCAGTAGGGATGAAGGCTAG
TTCCAGCCCCAGTCCAAAATAGTTCATAGGGCTAGGGAGAAAGGAAGATGGACTCTTGGCTTCCTCTCTCTGGC
TGGCAAAGGGAGTTATCTTCTGGAATACATTAGCTCTTTCAAAAACCCACCCAGTGTTTAGCCTCAACGGCAGC
CAGTTACCAGCTTCTCTCTGTAGCCTTCAGCAGTGTTTGCATCTCTGACATAACCACAGGCTGCTGTTTTCAAG
AAGAGCAATCTGTTTGGATAAGAAAAACCTTTACTTTACAGCTTCCCTTTATAATTTGTTACACAGGAATAGTT
AAATGCATTTGTTTGTTTGTTTTTTGAGACGGAGTTTCACTCTTGTTGCCCAGGCTGGAGGGCAATGGCGCGAT
CTCAGCTCACTGCAACCTCCGTCTCCTGGGTTCTTGATTCTCCTGTGTCAGCCTTCTGAGTAGCTGGGATTACA
GATGCCTATCACCATGCCTGGGTAATTTTTGTATTTTTAGTTGAGATGGGGTTTCGCCATGTTGGCCAGGCTGG
TCTCGAACTTCTGACCTCAGATGATCTGCCCGCCTCAGCCTCCCAAAGTGCTGGGATTACAGGCATGAGCCACC
ACGCCCAGCCATCAATGCATTTTTTTTATTTTTTTTTGAGACAGAGTTTCGCACTTCTTGCCCAGGCTGGAGT
ACAATGGTGCGATCTTGGCTCACTGCAACCTCCACCTCCTGGGTTCAAGCGCTTCTCCAGCCTCAGCCTCCTGA
GTAGCTGGGATTACAGGTATGTGCCACCATGCCTGGCTAATTTTGTATTTTTGGTGGAGACGGGGTTTCTCCAT
GTTGGTCAGACTGGTCTTGAACTCCCGACCTCAGGTAATCCGCCCGCCTCCGCCTCCCAAAATGCTGGGATTAG
AGGTGTGAGCCACTGTGCCCAGCCCATCAATGTGTTTTAAAGCTAGCTGTCAGGGTTCCACTTAATTTAAAGCT
GGGCAGGGAGATGTGTAATGATTTCAAAGTTAACACCTGTTTGTTTTCTAAAGGGCATGCCAAGTCCTGCTGTA
TCAGGGAAGTATTCTGTGCTAAAATCAGCGATGGTTCATTGCTCTAGTCTCTCTCACCCTTCTAGGCAGTGCAT
CAGTCAGCTCTAAATCTGGTGCAGAGGGTTAACAGCATAACCCTTGTTGGCAAAATGGAATAGATGTTAAGACC
TCAAATAGGGATTTGGGATGAAACAGCTGCAGTTAGCACTGTTATCTGAGCATGAAAGAACTGGAAACGCTCCT
TACGTCGAGATGTTGGACCTTGAAGCCCTCCTGAGGCCAACATGCAAATCTGGCTGTGACGGTTCATCTGACAC
CTGTGTAAAGCTGACCAGCCTGCTCTGTACAGTGACAATGAGGAGCCCCTCTCTTCCTTAAGTAGGAATCTGTG
AAGCAAAATGTTTGCTGCCAAAGACAAATCAGACTGTCAGTCATTAAAAACAGCATTAGCAGGATGAGGATAGC
AATGGGGAAGGGTTGTGGGCAATGCAGTAACAGGGAAATGGCTTCAGAAATGGTTTGAGTTGGAAGACAACATT
CTTCATCTCTCAGGACTTCTAATTCCTTGATGCTAAAAGAAGAGGCATGGATTCTATGAGCTTCCAAGTCCCTT
TCCACTTTAACCTTCTACAAATCTTTCAGAGGACTGCCTAGTAGCAAAGGTTATTCCTGGACACAGGAAAGACG
GGCATTACAGGGACCAAAGCTCTGAAAGGTGACTTTTATTACCAACACACTGGCTGGAAAAGGGACAAACCACA
TCACGGGTGAGTGATACTTCTCAGTCTTCTCTACTCATTCAACAAAGGAAATGTGGGCTGGGGCAGAGGTCTTT
TTTCATTTAATACTGGAAAAATATTGAAGAGCATCCATGTTCACTTATGGCTGGTTTTGCTATAGAAATTGGAA
AATAAAGGCCACTTTTTTG
```

FIGURE 50

MGPVVPSLGLLEGAPTRMVAAAVLQASRNPASTGQGPRCRESPGLLVVSGGKTNSLGQGRPP
TPRPLENGHGGRSLGPGPLDWVEMPDHQRHPSTAPPTDLTSHLSRISLAGVEPSLVQAALGQ
LVRLSCSDDTAPESQAAWQKDGQPISSDRHRLQFDGSLIIHPLQAEDAGTYSCGSTRPGRDS
QKIQLRIIGGDMAVLSEAELSRFPQPRDPAQDFGQAGAAGPLGAIPSSHPQPANRLRLDQNQ
PRVVDASPGQRIRMTCRAEGFPPPAIEWQRDGQPVSSPRHQLQPDGSLVISRVAVEDGGFYT
CVAFNGQDRDQRWVQLRVLGELTISGLPPTVTVPEGDTARLLCVVAGESVNIRWSRNGLPVQ
ADGHRVHQSPDGTLLIYNLRARDEGSYMCSAYQGSQAVSRSTEVKVVSPAPTAQPRDPGRDC
VDQPELANCDLILQAQLCGNEYYSSFCCASCSRFQPHAQPIWQ

Important features of the protein:
Signal peptide:
amino acids 1-16

Tyrosine kinase phosphorylation site.
amino acids 392-400

N-myristoylation sites.
amino acids 9-15, 50-56, 112-118, 146-152, 173-179, 195-201,
220-226, 229-235, 280-286, 306-312, 336-342, 397-403

Myelin P0 protein.
amino acids 153-182

FIGURE 51

CAGGCAGAAGCGAACAAAGACCCAGCAAGAGAAGGCAGAGGCTAAGACCCATCCCGTATCTG
CTCTCCTGAAATAATTCTGGAGTC<u>ATG</u>CCTGAAATGCCAGAGGACATGGAGCAGGAGGAAGT
TAACATCCCTAATAGGAGGGTTCTGGTTACTGGTGCCACTGGGCTTCTTGGCAGAGCTGTAC
ACAAAGAATTTCAGCAGAATAATTGGCATGCAGTTGGCTGTGGTTTCAGAAGAGCAAGACCA
AAATTTGAACAGGTTAATCTGTTGGATTCTAATGCAGTTCATCACATCATTCATGATTTTCA
GCCCCATGTTATAGTACATTGTGCAGCAGAGAGAAGACCAGATGTTGTAGAAAATCAGCCAG
ATGCTGCCTCTCAACTTAATGTGGATGCTTCTGGGAATTTAGCAAAGGAAGCAGCTGCTGTT
GGAGCATTTCTCATCTACATTAGCTCAGATTATGTATTTGATGGAACAAATCCACCTTACAG
AGAGGAAGACATACCAGCTCCCCTAAATTTGTATGGCAAAACAAAATTAGATGGAGAAAAGG
CTGTCCTGGAGAACAATCTAGGAGCTGCTGTTTTGAGGATTCCTATTCTGTATGGGGAAGTT
GAAAAGCTCGAAGAAAGTGCTGTGACTGTTATGTTTGATAAAGTGCAGTTCAGCAACAAGTC
AGCAAACATGGATCACTGGCAGCAGAGGTTCCCCACACATGTCAAAGATGTGGCCACTGTGT
GCCGGCAGCTAGCAGAGAAGAGAATGCTGGATCCATCAATTAAGGGAACCTTTCACTGGTCT
GGCAATGAACAGATGACTAAGTATGAAATGGCATGTGCAATTGCAGATGCCTTCAACCTCCC
CAGCAGTCACTTAAGACCTATTACTGACAGCCCTGTCCTAGGAGCACAACGTCCGAGAAATG
CTCAGCTTGACTGCTCCAAATTGGAGACCTTGGGCATTGGCCAACGAACACCATTTCGAATT
GGAATCAAAGAATCACTTTGGCCTTTCCTCATTGACAAGAGATGGAGACAAACGGTCTTTCA
T<u>TAG</u>TTTATTTGTGTTGGGTTCTTTTTTTTTTAAATGAAAAGTATAGTATGTGGCACTTTT
TAAAGAACAAAGGAAATAGTTTTGTATGAGTACTTTAATTGTGACTCTTAGGATCTTTCAGG
TAAATGATGCTCTTGCACTAGTGAAATTGTCTAAAGAAACTAAAGGGCAGTCATGCCCTGTT
TGCAGTAATTTTTCTTTTTATCATTTTGTTTGTCCTGGCTAAACTTGGAGTTTGAGTATAGT
AAATTATGATCCTTAAATATTTGAGAGTCAGGATGAAGCAGATCTGCTGTAGACTTTTCAGA
TGAAATTGTTCATTCTCGTAACCTCCATATTTTCAGGATTTTTGAAGCTGTTGACCTTTTCA
TGTTGATTATTTTAAATTGTGTGAAATAGTATAAAAATCATTGGTGTTCATTATTTGCTTTG
CCTGAGCTCAGATCAAAATGTTTGAAGAAAGGAACTTTATTTTTGCAAGTTACGTACAGTTT
TTATGCTTGAGATATTTCAACATGTTATGTATATTGGAACTTCTACAGCTTGATGCCTCCTG
CTTTTATAGCAGTTTATGGGGAGCACTTGAAAGAGCGTGTGTACATGTATTTTTTTCTAGG
CAAACATTGAATGCAAACGTGTATTTTTTAATATAAATATATAACTGTCCTTTTCATCCCA
TGTTGCCGCTAAGTGATATTTCATATGTGTGGTTATACTCATAATAATGGGCCTTGTAAGTC
TTTTCACCATTCATGAATAATAATAAATATGTACTGCTGGCATGTAATGCTTAGTTTTCTTG
TATTTACTTCTTTTTTTAAATGTAAGGACCAAACTTCTAAACTAATTGTTCTTTTGTTGCTT
TAATTTTTAAAAATTACATTCTTCTGATGTAACATGTGATACATACAAAAGAATATAGTTTA
ATATGTATTGAAATAAAACACAATAAAATT

FIGURE 52

MPEMPEDMEQEEVNIPNRRVLVTGATGLLGRAVHKEFQQNNWHAVGCGFRRARPKFEQVNLL
DSNAVHHIIHDFQPHVIVHCAAERRPDVVENQPDAASQLNVDASGNLAKEAAAVGAFLIYIS
SDYVFDGTNPPYREEDIPAPLNLYGKTKLDGEKAVLENNLGAAVLRIPILYGEVEKLEESAV
TVMFDKVQFSNKSANMDHWQQRFPTHVKDVATVCRQLAEKRMLDPSIKGTFHWSGNEQMTKY
EMACAIADAFNLPSSHLRPITDSPVLGAQRPRNAQLDCSKLETLGIGQRTPFRIGIKESLWP
FLIDKRWRQTVFH

Signal peptide:
amino acids 1-30

Transmembrane domain:
amino acids 105-127

N-glycosylation site.
amino acids 197-201

N-myristoylation site.
amino acids 303-309

Short-chain dehydrogenases/reductases family proteins.
amino acids 18-30

FIGURE 53

```
TGGGCTCCCTCCAGCACTGCTGTTGCCTGCTGCCTAAGATGGGTGACACTTGGGCCCAGCTTCCCTGGCCTGGG
CCACCCCACCCAGCAATGCTGCTGATCTCCCTCCTCTTGGCAGCCGGGTTGATGCACTCGGATGCCGGCACCAG
CTGCCCCGTCCTTTGCACATGCCGTAACCAGGTGGTGGATTGTAGCAGCCAGCGGCTATTCTCCGTGCCCCCAG
ACCTGCCAATGGACACCCGAAACCTCAGCCTGGCCCACAACCGCATCACAGCAGTGCCGCCTGGCTACCTCACA
TGCTACATGGAGCTCCAGGTGCTGGATTTGCACAACAACTCCTTAATGGAGCTGCCCCGGGGCCTCTTCCTCCA
TGCCAAGCGCTTGGCACACTTGGACCTGAGCTACAACAATTTCAGCCATGTGCCAGCCGACATGTTCCAGGAGG
CCCATGGGCTAGTCCACATCGACCTGAGCCACAACCCCTGGCTGCGGAGGGTGCATCCCCAGGCCTTTCAGGGC
CTCATGCAGCTCCGAGACCTGGACCTCAGTTATGGGGGCCTGGCCTTCCTCAGCCTGGAGGCTCTTGAGGGCCT
ACCGGGGCTGGTGACCCTGCAGATCGGTGGCAATCCCTGGGTGTGTGGCTGCACCATGGAACCCTGCTGAAGT
GGCTGCGAAACCGGATCCAGCGCTGTACAGCAGATTCTCAGCTGGCTGAGTGCCGGGGCCCTCCTGAAGTCGAG
GGCGCCCCGCTCTTCTCACTCACTGAGGAGAGCTTCAAGGCCTGCCACCTGACCCTGACCCTGGATGATTACCT
ATTCATTGCGTTCGTGGGCTTCGTGGTCTCCATTGCTTCTGTGGCCACCAACTTCCTCCTGGGCATCACTGCCA
ACTGCTGCCACCGCTGGAGCAAGGCCAGTGAAGAGGAAGAGATCTGACATGCCTGCCTCTCATCCCTCCATGCT
GCTGACCGCCACAGCTGCTGGCCACCAGACGCCCTCCCTGATTGCTCACTCTGGTTCCATGGTGACCTGGCTGC
CTCAGTCATGGTTCAAGCAAGGTGGGGACACTCATTTTGTATGAGCATCTGCTTTGGGCCAGGCGGCACGCTAG
GAATTGGGAACATCAGATGAACTGACTCAGTCCCTGCCCTCAAGGCACTTCCCTCTGGTCAAGGAGAGAGATCC
AAAAACTATTCCCTTTAAGACTATATGTCAGGACTCTGAGCACGTCATTATGGAGCCCAGAGGAGGAGCCATC
ATCTGTATCTAGCAATGTCCATGAGAATTATAAGATTAGAGTGATTTGTGAACTGGGTCATCAGGAAATATCTA
CTTTGTCAGGTAGGCAAAGAAGGGTGTCTGCACATGGCAGAGGCCAGAATATGCATAGTGTGCTGTGTTGAGAA
GAGTGAACAGTTCCTGGTCACTTACTTGTATAGAGGGGGTGTGGCACAGAACTCAAACCTACCCCTCACCTCCT
GACACCAAAACTGTCAGCTCTCAGCAATGCCAGCCACTGCCTACAGGGAGTAAGAACACCTCTATGACAGCCCC
TGGCCTCCTTCCACCAGCAGCTACCAGGTGAGACCACCTCCCAGTGACTGCCCCCATATGACCAAATGTCACCA
GTTGGTGAGGTCCCAGGCAGCAGGCTGAGGATGGACACTTTCAATGCCCTTGCTCCTGCCTCTCACTCAAGTTT
TGCTTCAGAAGAGAGAGGCAGGAGGCCCAGCAACTGGGGCAGCAAGAGTCCTGGCACCTTGGGATCCTAATCAT
GTGACTGTTCTTGCCACAGTGCTCATGCCACAGGGTCTCACCAGGAAAGTGCACTGTGGGCCACAGACCCACAG
CCTGGCAGCACCCAGAGCTAAAAGGGGACAAAGGCAGCACAGTTATGACCATATGAGGCTTTGCATTTTCTTCT
AAGCAACTTACCCACGTTAAGCATGAGGGTGAGAGAGCTATTAAATACTAAGCCCTTGCCAGTGTCAGGTACTT
TGAAAAGCTCTCTGCACAAACCATTCCCTTTGACACACACACACACAAATCTTTTGAGGTGAACGCTGTTGTTC
CCATTTTACGGATGAGGCAACTAAGGCTCAGAGAGGTTAAAGTCACATGCCACTATGAGCAAGATAAAGTCTGT
GCTCTTTCTACTGCCCCATCCAAGTTGGGGAACATCACCATTCCCTCTAGAGTTTATATAAATTCAAATTCAACT
AGAGCTGACAAAGTTCCTCATAAGGTCCAGGCACTCCTCTGGGCACTTTTATATCTATTGACTCACTTCTTTCA
ATTCTCACAGCAACACTGCCTGGTGGTTTTTATTATCCCCATTTGACAGATGAATTAATCGTAGAGAGTTGAGT
GACTTACCCAAGGTTGTCTGGATAAGCCCTAGAAGGAAGGCGGTAGGCAGCTCCATTCAGGGAAACTGCATCTA
ATCAGTCAGTCAAAAATCAAGTAACTTTACGAGCAAAGCACAATTATCATCATCGTGGTCTTCTTCATCAGTTT
CGTCAGCAGCATCATTATCTTCCCTCTATTTGTTCAGCACCGGATAGTTCATGAGTATTTTGCATCATTCTCC
TTGACTTTTCACATCCCTGTGCAGGAGGTAAATCAAACATCAGTAATCCTGTTTTACAGATGGGGAAAAAGTC
TCAAGGTTGGATATGACTTGCTATGTGGCAAGGTTGGGGCTCAACCCTAACACAGTTCTCTTTCCAGTGCTTTC
TCAAGTGCTTGGGGAAGAGAATGCCTCAGAAGGCTGGGTAGTGGGGCCCTGGAATTCAGCATCCATGAATGTGC
TAGTGGATAAGCTAAATAGAAGGCAGCCAAACCCATCTGCTGTACAGATTGAACTATGCTCACGGTAGGGCAAA
TTGCAGGCTCTGAAACAGAGACTACACAGGTAACACCTGAATAGGAGACTCCTGCTTTACAATGTGTAGATAAA
ACATCAGCAATGGTGGCCATGGTGGCAGTCATGTGAAAAGTAAGATCTTTGGGAATCAAGAAAGGAAGCTGTGT
TAACCACTCCTGCTCAAGCCCTGCTGCGTGTGTTGCAAGAGATACTAAGAGAGCAAGAAAGCTATAGGTGAGAA
CCTCTGCAGTTTAGGAGAAGAACATCAAGGCACAGTCCAACATGCTGATAAGTCTGGCCAGGAGGAGAATTAAA
ACAGGGGCTTTCCACACCTCCCTTGCCCCAAGCTCCAGCGGTATTCTATCAGCCCATCCTCCTGGAAAGCCTGA
AAGGAATGAAGGAGGCTAATAAGTCATCTTCCAGGAAGGCATCCCTCACTCGTGCTTCCCTGAGCTAGTCAACC
AAAAGAGTCTTCAGAAACTTTGCTAGACCTGAAGTACTTGAACCTGTGTCCCCTGAATCTTTCTTACAACATCT
GGGACAAATCCCTGGTCCTGTGACATCCGAAGCAGAACTGTGCCCTGCTCTCTCCTTCTGTGATGACCAAGGAT
GGTGAACTCAAGTTGTTCTCTACAAGCCAGGCCAGCAACCTAAATACTTGGAGAGGAACTTTTAGAAACTATAA
TCCTGACAAAATAGAAAAGTTTCCCATAGGGGCATACCATAATACTATAATAACCTCCCAGGAACTATTGTTTG
CCAAAATGTAGTTAATATATTTTAAGATATATGCTTTTTTGCATAGGACTAGAACCAGAAAAGACACCAAATGC
CCCCTTGACATCAATGTCCTTTCTAGTGGGACAATTTGGTCTCCATTAATGCCAAACCTTTCTGAACAGGATAC
ATGGCTTTTAAAGGACAGATGTTTCTCCTGCTGCTAGAAGTTCCTCAGTTTACTAGAGCACAATGAGGAAAGTA
TTCAACCTCCCTACTGCCAAGGAATTCCCTGCTTCTCCCCCACCGCCATCATCTTGTCCAAGCTATCAGAAGCA
ACCTTCTAGAGATAATCTAACAATCCTGATTAGAATTGCTCCCATATCCCTGGTGACCACAGGCTTCATTCAAA
TTGTCCAAACTGGTTAACATGTATGTGATGGGGTATCTCTGCATCTGTATGTCTGTCTGCGAGGTTCCTTGTAT
ATTGGCTGTCCGCTGACTTGGGACAGATCTCTCTAGAACTTGGGTTCAGTTCTCTGACATAGTCCACTCAGCCA
TAGGCTGAGTGGCTAAATATGCATAAATAAGCATGCCTAAATAGGCATATATAGGTTGGTGCAAAAGTAATTGC
GGTTTTTGCCATTAAAAATGATGGCAAAAATCCCAATTACTTTTGCGTCAATCTAATATTACATTGCTTGATAG
ATTAAGATGGAATCCCACCAGGTTTAGGGTAGGACTGGATGCTCAAAAAAAAAAAAAAAAAAAAAAAAAAAAAA
AAAAAA
```

FIGURE 54

MLLISLLLAAGLMHSDAGTSCPVLCTCRNQVVDCSSQRLFSVPPDLPMDTRNLSLAHNRITA
VPPGYLTCYMELQVLDLHNNSLMELPRGLFLHAKRLAHLDLSYNNFSHVPADMFQEAHGLVH
IDLSHNPWLRRVHPQAFQGLMQLRDLDLSYGGLAFLSLEALEGLPGLVTLQIGGNPWVCGCT
MEPLLKWLRNRIQRCTADSQLAECRGPPEVEGAPLFSLTEESFKACHLTLTLDDYLFIAFVG
FVVSIASVATNFLLGITANCCHRWSKASEEEEI

Important features of the protein:

Signal peptide:

amino acids 1-17

Transmembrane domain:

amino acids 241-260

N-glycosylation sites.

amino acids 52-55, 81-84, 107-110

Tyrosine kinase phosphorylation site.

amino acids 148-154

N-myristoylation sites.

amino acids 11-15, 263-268

Prokaryotic membrane lipoprotein lipid attachment site.

amino acids 175-185

Leucine zipper pattern.

amino acids 77-98

FIGURE 55

```
GGCTGCGCCCAGGCCGGCGGGCCCAGCAGCTGCGAACCGCCGGCGCACCACCTGTTTCCGCG
CCCGGGGACTTCCCCGGCGGGGCTCAGAAGTGTGGGGTCGGTCGCTTGGCTTCCCCTGGCGT
CAGCGACCCAGGGTAACCTCCTCCACTGCTGCGTGCCGTGCAGGCCTGCCTGTGTGAGAGCC
ACGTGTGCCGCGCTCTGGGCACAGCCTTGGAAAGTCAGGACCGCGACGGCAGCAGAGCAGAA
ACCTTACAGAAACATGAAGCCCTCAACCATCTGCTACTCAGTTATTCGGGGCTGACGGCGGC
TTCTAGAACATCCAGGTGTTCTGCAGATGCGAGAACTCATCCTGTAGTCACCAGATGGAGTC
CCAAACAGCCAAGCAGATGTAAGGCCTGTGCTGTGGCTCTGAGGCCCTGAATACAGAAGGGT
CACTTTCTTAGTGGCCAAAGAGCAGTTGTTGACATTGATGTCTAATTATTGAACACGACCAG
TCATTTTACTGAGCTGCAGTGAGGAAACACTGACCATAGAAGATCAAGCCAAATGAGGGATT
GCAAATTTCCTGATTCTTTTGAATTAGGATTCCAGATGGGGGCCTCATTTCTACAGCCCCCA
ACATTCCTATAGCCGTTATCACTGCCATCACCACTGCCACCAGCATCTTCTTGCAGATTCCA
CCCCTGCTCCCCAGAGACTTCCTGCTTTGAAAGTGAGCAGAAAGGAAGCTCTCAGAAAAATC
TCTAGTGGTGGCTGCCGTCGCTCCAGACAATCGGAATCCTGCCTTCACCACCATGGGCTGGC
TTTTTCTAAAGGTTTTGTTGGCGGGAGTGAGTTTCTCAGGATTTCTTTATCCTCTTGTGGAT
TTTTGCATCAGTGGGAAAACAAGAGGACAGAAGCCAAACTTTGTGATTATTTTGGCCGATGA
CATGGGGTGGGGTGACCTGGGAGCAAACTGGGCAGAAACAAAGGACACTGCCAACCTTGATA
AGATGGCTTCGGAGGGAATGAGGTTTGTGGATTTCCATGCAGCTGCCTCCACCTGCTCACCC
TCCCGGGCTTCCTTGCTCACCGGCCGGCTTGGCCTTCGCAATGGAGTCACACGCAACTTTGC
AGTCACTTCTGTGGGAGGCCTTCCGCTCAACGAGACCACCTTGGCAGAGGTGCTGCAGCAGG
CGGGTTACGTCACTGGATAATAGGCAAATGGCATCTTGGACACCACGGCTCTTATCACCCC
AACTTCCGTGGTTTTGATTACTACTTTGGAATCCCATATAGCCATGATATGGGCTGTACTGA
TACTCCAGGCTACAACCACCCTCCTTGTCCAGCGTGTCCACAGGGTGATGGACCATCAAGGA
ACCTTCAAAGAGACTGTTACACTGACGTGGCCCTCCCTCTTTATGAAAACCTCAACATTGTG
GAGCAGCCGGTGAACTTGAGCAGCCTTGCCCAGAAGTATGCTGAGAAAGCAACCCAGTTCAT
CCAGCGTGCAAGCACCAGCGGGAGGCCCTTCCTGCTCTATGTGGCTCTGGCCCACATGCACG
TGCCCTTACCTGTGACTCAGCTACCAGCAGCGCCACGGGGCAGAAGCCTGTATGGTGCAGGG
CTCTGGGAGATGGACAGTCTGGTGGGCCAGATCAAGGACAAAGTTGACCACACAGTGAAGGA
AAACACATTCCTCTGGTTTACAGGAGACAATGGCCCGTGGGCTCAGAAGTGTGAGCTAGCGG
GCAGTGTGGGTCCCTTCACTGGATTTTGGCAAACTCGTCAAGGGGAAGTCCAGCCAAGCAG
ACGACCTGGGAAGGAGGGCACCGGGTCCCAGCACTGGCTTACTGGCCTGGCAGAGTTCCAGT
TAATGTCACCAGCACTGCCTTGTTAAGCGTGCTGGACATTTTTCCAACTGTGGTAGCCCTGG
CCCAGGCCAGCTTACCTCAAGGACGGCGCTTTGATGGTGTGGACGTCTCCGAGGTGCTCTTT
GGCCGGTCACAGCCTGGGCACAGGGTGCTGTTCCACCCCAACAGCGGGGCAGCTGGAGAGTT
TGGAGCCCTGCAGACTGTCCGCCTGGAGCGTTACAAGGCCTTCTACATTACCGGTGGAGCCA
GGGCGTGTGATGGGAGCATGGTGCCTGAGCTGCAGCATAAGTTCCTCTGATTTTCAACCTG
GAAGACGATACCGCAGAAGCTGTGCCCCTAGAAAGAGGTGGTGCGGAGTACCAGGCTGTGCT
GCCCGAGGTCAGAAAGGTTCTTGCAGACGTCCTCCAAGACATTGCCAACGACAACATCTCCA
GCGCAGATTACACTCAGGACCCTTCAGTAACTCCCTGCTGTAATCCCTACCAAATTGCCTGC
CGCTGTCAAGCCGCATAACAGACCAATTTTTATTCCACGAGGAGGAGTACCTGGAAATTAGG
CAAGTTTGCTTCCAAATTTCATTTTTACCCTCTTTACAAACACACGCTTTAGTTTAGTCTTG
GAGTTTAGTTTTGGAGTTAGCCTTGCATATCCCTTCTGTATCCTGTCCCCCCTCCACGCCGA
CCCGAGAGCAGCTGAGCTGCGCTGGCTCTGGGCAGGGAGTGTGCCTTAATGGGAAGCACACG
GGCTTTGGAGTCAGGCACAGGTGCCAGCTCCAGCTTTTGAACTTGGGCAATTGTTTAACCTA
ACCTGCAAGTTGATTTTGAGGGTTAAATAAAGGCATACATGAAAATGCCTGGCAACTTTAAA
AAAAAAAA
```

FIGURE 56

MGWLFLKVLLAGVSFSGFLYPLVDFCISGKTRGQKPNFVIILADDMGWGDLGANWAETKDTA
NLDKMASEGMRFVDFHAAASTCSPSRASLLTGRLGLRNGVTRNFAVTSVGGLPLNETTLAEV
LQQAGYVTGIIGKWHLGHHGSYHPNFRGFDYYFGIPYSHDMGCTDTPGYNHPPCPACPQGDG
PSRNLQRDCYTDVALPLYENLNIVEQPVNLSSLAQKYAEKATQFIQRASTSGRPFLLYVALA
HMHVPLPVTQLPAAPRGRSLYGAGLWEMDSLVGQIKDKVDHTVKENTFLWFTGDNGPWAQKC
ELAGSVGPFTGFWQTRQGGSPAKQTTWEGGHRVPALAYWPGRVPVNVTSTALLSVLDIFPTV
VALAQASLPQGRRFDGVDVSEVLFGRSQPGHRVLFHPNSGAAGEFGALQTVRLERYKAFYIT
GGARACDGSMVPELQHKFPLIFNLEDDTAEAVPLERGGAEYQAVLPEVRKVLADVLQDIAND
NISSADYTQDPSVTPCCNPYQIACRCQAA

Important features of the protein:

Signal peptide:

amino acids 1-16

Transmembrane domain:

amino acids 353-373

N-glycosylation sites.

amino acids 117-120, 215-218, 356-359, 397-500

N-myristoylation sites.

amino acids 12-17, 33-38, 52-57, 97-102, 101-106, 113-118, 158-163, 328-333, 388-393, 418-423, 435-440, 436-441

Amidation site.

amino acids 382-385

Sulfatases signature 2.

amino acids 129-138

FIGURE 57

```
TGGACAAGACACCTCCAGGAGCCCAGCTCACAGCCACCGGTACCTTCTTCCAGGACAAGCTG
GGGGCCTCCATGGGCGCCTGAGGGCCAGGCGCCAGGGCCGTGGGCACGAGTATGGTGAGACA
CCAGCCCCTGCAGTACTACGAGCCACAGCTGTGCCTCTCCTGCCTCACGGGCATCTACGGCT
GCCGTTGGAAGCGCTACCAGCGCTCCCATGATGATACCACACCGGGCACAGCGCCATTCCTG
CATGTGGGGGCTGTGGCAGCAGTCACCATGCTCTCCTGGATCGTGGCAGGACAGTTCGCCCG
TGCAGAGCGGACCTCCTCCCAGGTGACCATTCTCTGTACCTTCTTCACCGTGGTGTTTGCCC
TCTACCTGGCCCCTCTCACCATCTCCTCTCCCTGCATCATGGAGAAGAAAGACCTCGGCCCC
AAGCCTGCTCTCATTGGCCACCGCGGGGCCCCATGCTGGCTCCAGAGCACACGCTCATGTC
CTTCCGGAAGGCCCTCGAGCAGAAGCTGTACGGGCTCCAGGCTGACATTACCATCAGCCTGG
ACGGCGTGCCCTTCCTCATGCATGACACCACCCTGCGGCGCACCACCAACGTGGAGGAGGAG
TTCCCGGAGCTGGCCCGCAGGCCTGCCTCCATGCTTAACTGGACCACCCTGCAGAGACTCAA
CGCTGGCCAGTGGTTCCTGAAGACTGACCCCTTCTGGACAGCCAGCTCCCTGTCACCCTCCG
ACCACAGAGAGGCCCAGAACCAGTCCATCTGCAGCCTGGCAGAGCTCCTGGAGCTGGCCAAG
GGCAATGCCACACTGCTGCTCAACCTGCGTGACCCGCCCCGGGAGCACCCCTACCGCAGCAG
TTTTATCAACGTGACTCTGGAGGCCGTGCTGCACTCCGGCTTCCCCCAGCACCAGGTCATGT
GGCTGCCTAGCAGGCAGAGGCCCCTGGTGCGGAAGGTGGCTCCCGGCTTCCAACAGACATCA
GGCTCCAAGGAGGCAGTCGCCAGCCTGCGGAGAGGCCACATCCAGCGGCTGAACCTGCGCTA
CACTCAGGTGTCCGCCAGGAGCTCAGGGACTACGCGTCCTGGAACCTGAGTGTGAACCTCT
ACACAGTCAACGCACCGTGGCTCTTCTCCCTGCTGTGGTGTGCGGGGGTCCCATCCGTCACC
TCTGACAACTCCCACACCCTGTCCCAGGTGCCTTCCCCCCTCTGGATCATGCCCCCGGACGA
GTACTGTCTCATGTGGGTCACTGCCGACCTGGTCTCCTTCACCCTCATCGTGGGCATCTTCG
TGCTCCAGAAGTGGCGCCTGGGTGGCATACGGAGCTACAACCCTGAGCAGATCATGCTGAGT
GCTGCGGTGCGCCGGACCAGCCGGGACGTCAGCATCATGAAGGAGAAGCTTATTTTCTCAGA
GATCAGCGATGGTGTAGAGGTCTCCGATGTGCTCTCCGTATGTTCAGACAACAGTTATGACA
CATATGCCAACAGCACCGCCACCCCTGTGGGCCCCGAGGGGGTGGCAGCCACACCAAGACC
CTCATAGAGCGGAGTGGGCGTTAGCTGAAGACATGTCTGTCCCACCTGTACCTGACACAGAA
GCTGGGGAGCCTAGGAGAGCTGGTGGAAGTGTGTCTGAACTCGGAGTGCTCTGGGAGCGGGC
TCCACAGCCTCCTTGTGGGCTCCAGCCCCTTGTCAGCCGCAGCCTCTCTTGAGGGGACTCC
CTGTCTCCTGAGGCCCAGCTGGGCCAGGACTCCATCCTTTCAGATGCCCCTGCAGGCCTGGG
GCTCCTTCTGGGAAGTATGGGGCCTAGGGCTTGGTCCCCCTCTTCTGAGGCCCTCTCCTGTA
TCCCGACCTGGAAGCTTTGATGGGTCATGGGCCATGCCATACCCCCTGTGGCAATGGAGTGT
GTGGATGCTCACCTGTGCCATCTGTCCTCCTGTCTGTGCCAGGAGGCACCTGAGTTCTCTGC
TGTTATCCTGCCCCAAGGGCCTGGGCCGAGCCTCTACCTGAAGCAACTCTGCTCTTCCTGTC
AGTCTCAAAGCACAAGGAGGTTCAGCCCAGGAGGAAGCCAGCTGCAATGTGGAGACACGTCC
TCCTCCCCAACCCACCTCATGCCACCGCCAACCCCTGCCCAGGAGCGGGCCTGAGCCACG
TCCCCTAGGAGCAGCTGGAGATGGCCAAAAGAGTGAGCTCAGGACTACTGGATCCCATGCCC
AGGTGTCCAGCAGACCTCAAGGCAGAAGGGTCACCTAACCCAGGAGTCCACAGACTGATGTG
ACCTCAGGTTCCCACATCAGTGGCCACAGGGCAGGGCCCACCTGGTAGAAGTGTTCTGGATA
TGGCCAGGGTGGGTGTGTGGCTAAGTGGGCCTGAACAGAGGGAACCTAGGGCCCTTGGCCAA
TGTGATTAAAGCTGCCATCTTGAAA
```

FIGURE 58

MVRHQPLQYYEPQLCLSCLTGIYGCRWKRYQRSHDDTTPGTAPFLHVGAVAAVTMLSWIVAG
QFARAERTSSQVTILCTFFTVVFALYLAPLTISSPCIMEKKDLGPKPALIGHRGAPMLAPEH
TLMSFRKALEQKLYGLQADITISLDGVPFLMHDTTLRRTTNVEEEFPELARRPASMLNWTTL
QRLNAGQWFLKTDPFWTASSLSPSDHREAQNQSICSLAELLELAKGNATLLLNLRDPPREHP
YRSSFINVTLEAVLHSGFPQHQVMWLPSRQRPLVRKVAPGFQQTSGSKEAVASLRRGHIQRL
NLRYTQVSRQELRDYASWNLSVNLYTVNAPWLFSLLWCAGVPSVTSDNSHTLSQVPSPLWIM
PPDEYCLMWVTADLVSFTLIVGIFVLQKWRLGGIRSYNPEQIMLSAAVRRTSRDVSIMKEKL
IFSEISDGVEVSDVLSVCSDNSYDTYANSTATPVGPRGGGSHTKTLIERSGR

Important features of the protein:

Signal peptide:

amino acids 1-24

Transmembrane domains:

amino acids 47-61, 77-93, 335-350, 380-399

N-glycosylation sites.

amino acids 182-186, 217-221, 233-237, 255-259, 329-333, 462-466

Tyrosine kinase phosphorylation site.

amino acids 130-139

N-myristoylation sites.

amino acids 21-27, 48-54, 294-300, 404-410, 442-448, 473-479

FIGURE 59

```
CCTGAGCAAACACAGCAGCCCGAGTGTTCCCAAGGCCAAAATGCTGAGAACGTCCACTCCTA
ATCTGTGTGGTGGTCTGCATTGCCGGGCCCCTGGCTCTCTTCTGGCATTCTCTGCCTCTGC
CTCATATTCTTGTTAGGCCAGGTGGGCTTGCTGCAGGGACACCCCAGTGCCTGGATTACGG
GCCCCCTTTCCAGCCCCCTCTGCACCTTGAGTTTTGCTCTGACTATGAGTCCTTCGGCTGCT
GTGATCAGCACAAGGACCGCCGCATCGCTGCCCGGTACTGGGACATCATGGAATATTTTGAT
CTGAAGAGACATGAGCTGTGTGGAGATTACATTAAAGACATCCTTTGCCAGGAGTGCTCGCC
CTACGCAGCCCACCTCTACGACGCCGAAAACACCCAGACGCCTCTCCGGAATCTCCCGGGCC
TCTGCTCTGATTACTGCTCTGCCTTCCATTCTAACTGTCACTCAGCCATTTCCCTGCTGACC
AATGACCGCGGCCTCCAGGAGTCTCATGGAAGGGACGGTACCCGCTTCTGCCACCTCCTGGA
CCTTCCTGACAAGGACTATTGCTTCCCTAATGTCCTGAGGAACGACTATCTCAACCGCCACC
TGGGCATGGTGGCCCAAGATCCTCAGGGCTGCCTGCAGCTCTGCCTGAGCGAGGTGGCCAAC
GGGCTGAGGAACCCCGTCTCCATGGTCCATGCTGGGGACGGCACCCATCGCTTCTTTGTTGC
CGAGCAGGTAGGAGTGGTGTGGGTCTACCTCCCTGATGGGAGTCGCCTGGAGCAACCCTTCC
TGGACCTCAAGAACATCGTGTTGACCACCCCATGGATCGGGGATGAGAGAGGCTTCTTGGGG
TTGGCTTTTCACCCCAAATTCCGCCACAATCGCAAGTTCTATATTTATTATTCGTGCCTGGA
CAAGAAGAAGGTAGAAAAGATCCGAATTAGTGAGATGAAGGTTTCTCGGGCTGATCCTAACA
AAGCTGACCTGAAATCAGAGAGGGTCATCTTGGAGATTGAAGAACCAGCCTCAAACCATAAT
GGCGGACAACTTCTTTTTGGCCTGGATGGCTATATGTACATATTCACTGGGGACGGGGGACA
GGCTGGAGATCCCTTTGGCCTGTTTGGAAATGCTCAGAACAAAAGTTCCCTGCTGGGAAAAG
TTTTAAGGATCGATGTGAACAGGGCAGGCTCACATGGCAAGCGGTACCGAGTCCCCTCGGAC
AATCCATTTGTTTCTGAGCCAGGGGCCCACCCCGCCATCTATGCCTATGGGATCAGGAACAT
GTGGCGTTGTGCTGTGGACCGAGGGGACCCCATCACGCGCCAGGGCCGAGGCCGGATATTCT
GTGGGGACGTGGGCCAGAACAGGTTTGAAGAGGTTGACCTCATTTTGAAAGGTGGAAACTAT
GGCTGGAGAGCAAAGGAAGGGTTTGCATGTTATGACAAAAAACTTTGTCACAATGCCTCTTT
GGATGATGTTCTGCCAATCTATGCTTATGGCCATGCAGTGGGGAAGTCAGTCACTGGAGGTT
ATGTCTATCGTGGTTGTGAATCCCCAAATCTCAATGGCCTGTATATCTTTGGAGACTTCATG
AGTGGTCGACTTATGGCTTTGCAGGAAGATAGAAAAAACAAGAAATGGAAGAAGCAGGATCT
TTGCCTGGGCAGCACCACGTCCTGTGCCTTCCAGGGCTGATCAGCACCCATAGCAAGTTCA
TCATCTCCTTTGCTGAAGATGAAGCAGGGGAGCTGTATTTCCTGGCGACCTCTTACCCAAGT
GCCTATGCACCACGTGGATCTATTTACAAGTTTGTTGACCCCTCAAGGCGAGCACCCCCAGG
CAAGTGCAAATACAAGCCAGTGCCCGTGAGAACCAAGAGTAAGCGGATCCCGTTCAGACCAC
TCGCCAAGACAGTCTTGGACTTGCTAAAGGAACAATCAGAGAAAGCTGCTAGAAAATCTTCC
AGTGCAACCTTAGCTTCTGGCCCAGCCCAGGGTTTGTCTGAGAAAGGCTCCTCCAAGAAGCT
GGCTTCTCCTACAAGCAGCAAGAATACATTGCGAGGGCCTGGTACAAAGAAGAAAGCCAGAG
TGGGGCCCCACGTCCGCCAGGGCAAGAGGAGGAAGAGCCTGAAAGCCACAGTGGCAGGATG
AGGCCATCAGCAGAGCAGAAGCGAGCTGGCAGAAGTCTCCCTTGACCTATTGGTCAAGGTGG
CCGACAGGGTGACGTGAGAGAGGAGAGCCACCTCATCAAATGAAAGTCACTGCTGAATAAAG
ACCTTAGAAGTCTGGGAAGCCAGGGTAGAGGTGGGCAGGGCGGTTTTCCTCTCCCTGGGAA
ATCTTGCTGTCTACTGAATAAATAAATGCACCTTCTCTGTATGCAGTGCTTCTGTGGGAGAC
CATATCCCAGATTGCTGGTGCACCTGGGTTATGGTAAGCACTAGTCCATGAGCCTGCTTGGA
ATCACACTGGATGTCTCCGTTTTGTCTTGTAAATGCCTACAACCTGAGGTAATAAATCAACA
TTTGCTCA
```

FIGURE 60

MLRTSTPNLCGGLHCRAPWLSSGILCLCLIFLLGQVGLLQGHPQCLDYGPPFQPPLHLEFCS
DYESFGCCDQHKDRRIAARYWDIMEYFDLKRHELCGDYIKDILCQECSPYAAHLYDAENTQT
PLRNLPGLCSDYCSAFHSNCHSAISLLTNDRGLQESHGRDGTRFCHLLDLPDKDYCFPNVLR
NDYLNRHLGMVAQDPQGCLQLCLSEVANGLRNPVSMVHAGDGTHRFFVAEQVGVVWVYLPDG
SRLEQPFLDLKNIVLTTPWIGDERGFLGLAFHPKFRHNRKFYIYYSCLDKKKVEKIRISEMK
VSRADPNKADLKSERVILEIEEPASNHNGGQLLFGLDGYMYIFTGDGGQAGDPFGLFGNAQN
KSSLLGKVLRIDVNRAGSHGKRYRVPSDNPFVSEPGAHPAIYAYGIRNMWRCAVDRGDPITR
QGRGRIFCGDVGQNRFEEVDLILKGGNYGWRAKEGFACYDKKLCHNASLDDVLPIYAYGHAV
GKSVTGGYVYRGCESPNLNGLYIFGDFMSGRLMALQEDRKNKKWKKQDLCLGSTTSCAFPGL
ISTHSKFIISFAEDEAGELYFLATSYPSAYAPRGSIYKFVDPSRRAPPGKCKYKPVPVRTKS
KRIPFRPLAKTVLDLLKEQSEKAARKSSSATLASGPAQGLSEKGSSKKLASPTSSKNTLRGP
GTKKKARVGPHVRQGKRRKSLKSHSGRMRPSAEQKRAGRSLP

Important features of the protein:

Signal peptide:

amino acids 1-41

Transmembrane domain:

amino acids 17-36

N-glycosylation sites.

amino acids 372-376, 480-484 cAMP- and cGMP-dependent protein kinase phosphorylation site.

amino acids 645-649, 699-703

Tyrosine kinase phosphorylation site.

amino acids 81-89

N-myristoylation sites.

amino acids 11-17, 37-43, 156-162, 165-171, 357-363, 365-371, 368-374, 408-414, 459-465, 548-554, 557-563

Amidation sites.

amino acids 391-395, 696-700

Cell attachment sequence.

amino acids 428-431

Leucine zipper pattern.

amino acids 25-47

FIGURE 61

CTCCATTAAACCACCACCAGCTCCCCAAGCCACCCCTTCAGCC<u>ATG</u>AAGTTCCTGCTCCTGGT
CTTGGCAGCCCTCGGATTCCTGACCCAGGTGATCCCAGCCAGTGCAGGTGGGTCAAAATGTGT
GAGTAACACCCCAGGATACTGCAGGACATGTTGCCACTGGGGGGAGACAGCATTGTTCATGTG
CAACGCTTCCAGAAAATGCTGCATCAGCTACTCCTTCCTGCCGAAGCCTGACCTACCACAGCT
CATCGGTAACCACTGGCAATCAAGGAGAAGAAACACACAAAGGAAAGACAAGAAGCAACAAAC
GACCGTAACATCA<u>TAA</u>TAACCACTGCTATCGCCTCCACCAACTCAGAGAAATATCATTTCCAC
AGTTCCAATTCCTCCTACATTGCTGAGTACTAGCCAAGGCTCCTCTTTATGGGGCAGATATCT
ATAGCCAACCCCAAAACTTCTGTCTTCTATCATTCTGTCATTCATCTAGTAACTAATTTGGAG
TTTGTATCTATCTTACGAGAACAATCATCATGCAGATTCGTCCACAGGGGATCTGTCAGTTTG
GGTCCTCCAAATGAAAAATGTCAAGACAGAATTGGACATGCAAAAGATTGACTGGGAGAACAC
ACCTCTGATGGACAAAGGTGAGACAGAGCAGCCACAGGCAGGGAGAGCCTTCAGACTGCAACG
CTGGCCTGATACGTGTCAAAGGAGAGAGGGATAGAGGAGGATTGAATAGAAGGAGACTAAGAC
TGCAGCTCTAAGAAAGTCTCAGCCAAACAGATGGGGAGGCCCAAAGCAAGGCTTGCCCCTCAG
AGGAGCTCACGCAGGGCAGGAATAGCCAGGTTCTCATATCCCAGGGGTTCAGACTTGGCTGAG
AACAGCCCCTGGAGAACATGGGGTGACTGCTACCATAGGTCTGGAAGTATGAGGCTGTCCACC
AACTATCCCCTTGAAGCAAGTTCTCTTGAAAGGAAATCTAAACAGTGCACCCCATGGCTGCC
ACGGAGTATAAGGAGGGAGAGAAAGGAGCTGAAAGTCTAGGTTTGGCCAGCTAGGTAGACTGA
CTTGTGAGGTATTTATTTATTCATTTGAGTAACAAAGCAGACAGAATACATAGCCACCATTGG
TAGTACACCCCAAAAGCAAGGATGGCATGATGCTGGTGACTCAAACGTGCCTACTCATGGTGT
CAAATTGGCATAATCCTCTTGGGAAGCTGTGTGGAAATAAGCACAGAGAAGCAGAACTCTAAT
TGCTTAATCCACTAAACATTACTTCTGGGAATTGGCTCATCATAAATTATCCAAGAGAAAGCA
CAAAGTTATGGGCACAAAGGTTTTCCATATAATATTATTTAAAATGCTGAGAAAATGAAAAAA
TCTAAATGGTGAAATATATACTAATGCCATCTATAAATACAAACAAATAGAATGTTTATAGAA
TAATGGAACATAATAACATTATTCAAAATTGCATTTATGCTATAGTTGTCAAAATTGTCTCCT
TATATGATACAAAACTCATGAAAATTATGACTTTTTGTTTGGTTGGAAAGCAGAATTATGCA
TAAATTTCCTCTTACAGTTCGATGCCCATTAGTTTTATATAACATTTATTTGACACGTACTGA
CTTCTATCTGAGAAGAACAAACCAAAACACTCAGGCCTAAATAATTAAAAACGGTCCTAAAAA
CTAGCAAACCAGATAAGAAAGATGTTAATGCCCATTCCCTAACTTATGTCTTAGACCAAAAT
TAATTCTAGATGGTTTTAAAATGACAGTGTAAAAGTAAAGTATTAAAAGATTGTGTGGTCAAA
TATTCAATTTAAGAGCAAGGAAATTCTTATAAATATAACAATAGAGGCAGAACTCATGTAAGA
ATAAATTGATTAGGTGGTATTAAATATTAAGTTCTTATGTATGTCAAAAGATATCATTTTGAA
ATTCATCCATCTTATTGGGTATTGCAGGAGTTCATTCCTTTTTGTTTATAAATACTCTTCCGT
CATATGAATAGTATTCATTTGTATACTGGTTTGTTGATGGACATTTGGGTTGTTCCCAGTTTA
TGGCTATTACAAATAAAGCTTCTATGAACATTTATGTACA

FIGURE 62

MKFLLLVLAALGFLTQVIPASAGGSKCVSNTPGYCRTCCHWGETALFMCNASRKCCISYSFL
PKPDLPQLIGNHWQSRRRNTQRKDKKQQTTVTS

Important features of the protein:

Signal peptide:

amino acids 1-16

Transmembrane domain:

amino acids 1-22

N-glycosylation site.

amino acids 50-53 cAMP- and cGMP-dependent protein kinase phosphorylation site.

amino acids 79-82

N-myristoylation site.

amino acids 23-28

FIGURE 63

```
GCGGAGCGCCTGGGAGAGGAGAAGGAGCCGACCTGCCGAGATGGAGGCGACCGGCACCTGGG
CGCTGCTGCTGGCGCTGGCGCTGCTCCTGCTGCTGACGCTGGCGCTGTCCGGGACCAGGGCC
CGAGGCCACCTGCCCCCGGGCCCACGCCGCTACCACTGCTGGGAAACCTCCTGCAGCTACG
GCCCGGGGCGCTGTATTCAGGGCTCATGCGGCTGAGTAAGAAGTACGGACCGGTGTTCACCA
TCTACCTGGGACCCTGGCGGCCTGTGGTGGTCCTGGTTGGGCAGGAGGCTGTGCGGGAGGCC
CTGGGAGGTCAGGCTGAGGAGTTCAGCGGCCGGGGAACCGTAGCGATGCTGGAAGGGACTTT
TGATGGCCATGGGGTTTTCTTCTCCAACGGGGAGCGGTGGAGGCAGCTGAGGAAGTTTACCA
TGCTTGCTCTGCGGGACCTGGGCATGGGGAAGCGAGAAGGCGAGGAGCTGATCCAGGCGGAG
GCCCGGTGTCTGGTGGAGACATTCCAGGGGACAGAAGGACGCCCATTCGATCCCTCCCTGCT
GCTGGCCCAGGCCACCTCCAACGTAGTCTGCTCCCTCCTCTTTGGCCTCCGCTTCTCCTATG
AGGATAAGGAGTTCCAGGCCGTGGTCCGGGCAGCTGGTGGTACCCTGCTGGGAGTCAGCTCC
CAGGGGGGTCAGACCTACGAGATGTTCTCCTGGTTCCTGCGGCCCCTGCCAGGCCCCCACAA
GCAGCTCCTCCACCACGTCAGCACCTTGGCTGCCTTCACAGTCCGGCAGGTGCAGCAGCACC
AGGGGAACCTGGATGCTTCGGGCCCCGCACGTGACCTTGTCGATGCCTTCCTGCTGAAGATG
GCACAGGAGGAACAAAACCCAGGCACAGAATTCACCAACAAGAACATGCTGATGACAGTCAT
TTATTTGCTGTTTGCTGGGACGATGACGGTCAGCACCACGGTCGGCTATACCCTCCTGCTCC
TGATGAAATACCCTCATGTCCAAAAGTGGGTACGTGAGGAGCTGAATCGGGAGCTGGGGGCT
GGCCAGGCACCAAGCCTAGGGGACCGTACCCGCCTCCCTTACACCGACGCGGTTCTGCATGA
GGCGCAGCGGCTGCTGGCGCTGGTGCCCATGGGAATACCCCGCACCCTCATGCGGACCACCC
GCTTCCGAGGGTACACCCTGCCCCAGGGCACGGAGGTCTTCCCCCTCCTTGGCTCCATCCTG
CATGACCCCAACATCTTCAAGCACCCAGAAGAGTTCAACCCAGACCGTTTCCTGGATGCAGA
TGGACGGTTCAGGAAGCATGAGGCGTTCCTGCCCTTCTCCTTAGGGAAGCGTGTCTGCCTTG
GAGAGGGCCTGGCAAAAGCGGAGCTCTTCCTCTTCTTCACCACCATCCTACAAGCCTTCTCC
CTGGAGAGCCCGTGCCCGCCGGACACCCTGAGCCTCAAGCCCACCGTCAGTGGCCTTTTCAA
CATTCCCCCAGCCTTCCAGCTGCAAGTCCGTCCCACTGACCTTCACTCCACCACGCAGACCA
GATGAAGGAAGGCAACTTGGAAGTGGTGGGTGCCCAGGACGGTGCCTCCAGCCTCAACAGTG
GGCATGGACAGGGTTAATGTCTCCAGAGTGTACACTGCAGGCAGCCACATTTACACGCCTGC
AGTTGTTTTCCGGAGTCTGTCCCACGGCCCACACGCTCACTTGACTCATGCTGCTAAGATGC
ACAACCGCACACCCATACACAACTACAAGGGCCACAAAGCAACTGCTGGGTTAGCTTTCCAC
AGACATAAATATAGTCCATCTGCAATCACAAGCACATAGCCAGGTAACCCACCAACTCCCCT
GGATCTGCAGCCCACACGTGGGAGTCTGGCTGTCACCTTCACAAGCCACAGAAACGGCCACA
CATGTTCACAGCTCACACGCCCTCTCCATTCATCGAACTTCTCAGTGTCCCTGTCCCTGGTG
CCTGGCACAGGGAACAGCATGCCCCCTCCGGGGTCATGCCACCCAGAGACTGTCGCTGTCTA
TGGCCCCAACTCATGCTCCCTCTCTTGGCTACACCACTCTCCCAGCCTGTGACCACCGATGT
CCACACACCCCCAACCACTTGTCCACACAGCTACCCACGTACAACATCGTCCTGGCTCCCCA
GAGTATCTTCCCACTGAGACACGCCGCCCCACAGAGGCACAGTCCCCAGCCACCTCTGCAA
CTGCAGCCCTCAGTCACCCCTTTTTAAGCACCCTGATTCTACCAAATGCAAACACATCTGGG
TCTGCGATTATGCACAGAGACTTTGGACATACGAGGACCCTCAGACCGGAGGAACACCTGCC
CAACCCCAACACGTGCTTATGTAACCACGTGGAAAGCGGCCCCTGCTGCCCCTCCACACACA
CATACACACTCACTGATCTACAGCCCCTGTTCGGCGTCAGAGTCCCCACTAGACCCAGTGGA
AGGGGTTAGAGACCAAGTAGGGGCCAGTTTCCAATTCACCCTGTCAGGGAGTGAGCCGGATC
TGACGTTCCTTGTGACTTAAGGGTCCGGCTTGGGAATTAAAGTTTGTTTCTGGCCTTTAGCC
TAAAAAAAAAAAAAAAAAA
```

FIGURE 64

MEATGTWALLLALALLLLLTLALSGTRARGHLPPGPTPLPLLGNLLQLRPGALYSGLMRLSK
KYGPVFTIYLGPWRPVVVLVGQEAVREALGGQAEEFSGRGTVAMLEGTFDGHGVFFSNGERW
RQLRKFTMLALRDLGMGKREGEELIQAEARCLVETFQGTEGRPFDPSLLLAQATSNVVCSLL
FGLRFSYEDKEFQAVVRAAGGTLLGVSSQGGQTYEMFSWFLRPLPGPHKQLLHHVSTLAAFT
VRQVQQHQGNLDASGPARDLVDAFLLKMAQEEQNPGTEFTNKNMLMTVIYLLFAGTMTVSTT
VGYTLLLLMKYPHVQKWVREELNRELGAGQAPSLGDRTRLPYTDAVLHEAQRLLALVPMGIP
RTLMRTTRFRGYTLPQGTEVFPLLGSILHDPNIFKHPEEFNPDRFLDADGRFRKHEAFLPFS
LGKRVCLGEGLAKAELFLFFTTILQAFSLESPCPPDTLSLKPTVSGLFNIPPAFQLQVRPTD
LHSTTQTR

Important features of the protein:

Signal peptide:

amino acids 1-28

Transmembrane domain:

amino acids 294-313

Glycosaminoglycan attachment site.

amino acids 99-103 cAMP- and cGMP-dependent protein kinase phosphorylation site.

amino acids 128-132

N-myristoylation sites.

amino acids 51-57, 109-115, 115-121, 188-194, 207-213, 257-263, 284-290, 339-345, 370-376, 444-450

Amidation sites.

amino acids 140-144, 435-439

Leucine zipper pattern.

amino acids 32-54, 39-61

Cytochrome P450 cysteine heme-iron ligand signature.

amino acids 433-443

FIGURE 65

CGGACGCGTGGGGCCGTATGCGCGGCTCTGTGGAGTGCACCTGGGGTTGGGGGCACTGTGCC
CCCAGCCCCCTGCTCCTTTGGACTCTACTTCTGTTTGCAGCCCCATTTGGCCTGCTGGGGGA
GAAGACCCGCCAGGTGTCTCTGGAGGTCATCCCTAACTGGCTGGGCCCCCTGCAGAACCTGC
TTCATATACGGGCAGTGGGCACCAATTCCACACTGCACTATGTGTGGAGCAGCCTGGGGCCT
CTGGCAGTGGTAATGGTGGCCACCAACACCCCCACAGCACCCTGAGCATCAACTGGAGCCT
CCTGCTATCCCCTGAGCCCGATGGGGGCCTGATGGTGCTCCCTAAGGACAGCATTCAGTTTT
CTTCTGCCCTTGTTTTACCAGGCTGCTTGAGTTTGACAGCACCAACGTGTCCGATACGGCA
GCAAAGCCTTTGGAAGACCATATCCTCCATACTCCTTGGCCGATTTCTCTTGGAACAACAT
CACTGATTCATTGGATCCTGCCACCCTGAGTGCCACATTTCAAGGCCACCCCATGAACGACC
CTACCAGGACTTTTGCCAATGGCAGCCTGGCCTTCAGGGTCCAGGCCTTTTCCAGGTCCAGC
CGACCAGCCCAACCCCCTCGCCTCCTGCACACAGCAGACACCTGTCAGCTAGAGGTGGCCCT
GATTGGAGCCTCTCCCCGGGGAAACCGTTCCCTGTTTGGGCTGGAGGTAGCCACATTGGGCC
AGGGCCCTGACTGCCCCTCAATGCAGGAGCAGCACTCCATCGACGATGAATATGCACCGGCC
GTCTTCCAGTTGGACCAGCTACTGTGGGGCTCCCTCCCATCAGGCTTTGCACAGTGGCGACC
AGTGGCTTACTCCCAGAAGCCGGGGGGCCGAGAATCAGCCCTGCCCTGCCAAGCTTCCCCTC
TTCATCCTGCCTTAGCATACTCTCTTCCCCAGTCACCCATTGTCCGAGCCTTCTTTGGGTCC
CAGAATAACTTCTGTGCCTTCAATCTGACGTTCGGGGCTTCCACAGGCCCTGGCTATTGGGA
CCAACACTACCTCAGCTGGTCGATGCTCCTGGGTGTGGGCTTCCCTCCAGTGGACGGCTTGT
CCCCACTAGTCCTGGGCATCATGGCAGTGGCCCTGGGTGCCCCAGGGCTCATGCTGCTAGGG
GGCGGCTTGGTTCTGCTGCTGCACCACAAGAAGTACTCAGAGTACCAGTCCATAAATTAAGG
CCCGCTCTCTGGAGGGAAGGACATTACTGAACCTGTCTTGCTGTGCCTCGAAACTCTGGAGG
TTGGAGCATCAAGTTCCAGCCGGCCCCTTCACTCCCCCATCTTGCTTTTCTGTGGAACCTCA
GAGGCCAGCCTCGACTTCCTGGAGACCCCCAGGTGGGGCTTCCTTCATACTTTGTTGGGGGA
CTTTGGAGGCGGGCAGGGACAGGGCTATTGATAAGGTCCCCTTGGTGTTGCCTTCTTGCAT
CTCCACACATTTCCCTTGGATGGGACTTGCAGGCCTAAATGAGAGGCATTCTGACTGGTTGG
CTGCCCTGGAAGGCAAGAAAATAGATTTATTTTTTTTCACAGGGAAAAAAAAAAAA

FIGURE 66

MRGSVECTWGWGHCAPSPLLLWTLLLFAAPFGLLGEKTRQVSLEVIPNWLGPLQNLLHIRAV
GTNSTLHYVWSSLGPLAVVMVATNTPHSTLSINWSLLLSPEPDGGLMVLPKDSIQFSSALVF
TRLLEFDSTNVSDTAAKPLGRPYPPYSLADFSWNNITDSLDPATLSATFQGHPMNDPTRTFA
NGSLAFRVQAFSRSSRPAQPPRLLHTADTCQLEVALIGASPRGNRSLFGLEVATLGQGPDCP
SMQEQHSIDDEYAPAVFQLDQLLWGSLPSGFAQWRPVAYSQKPGGRESALPCQASPLHPALA
YSLPQSPIVRAFFGSQNNFCAFNLTFGASTGPGYWDQHYLSWSMLLGVGFPPVDGLSPLVLG
IMAVALGAPGLMLLGGGLVLLLHHKKYSEYQSIN

N-glycosylation sites:

amino acids 65-69, 95-99, 134-138, 159-163, 187-191, 230-234, 333-337 cAMP- and cGMP-dependent protein kinase phosphorylation site:

amino acids 397-401

Casein kinase II phosphorylation sites:

amino acids 151-155, 249-253, 255-259

N-myristoylation sites:

amino acids 3-9, 63-69, 235-241, 273-279, 292-298, 324-330

Leucine zipper pattern.

amino acids 371-393

FIGURE 67

```
CGGGACAGGCGCGTGAGGCCACAACACATGCGTGTATCTTGCTTGGGCTATCTTCCCTGCTCTGCCACGCCGGG
TCTGGAGAAGGGGTTTCAGCCCCAGGACATTTACTGAGAGTCGGCGAATATTGGGAGCCGCGATGTTCCCCCTT
CGGGCCCTGTGGTTGGTCTGGGCGCTTCTAGGAGTGGCCGGATCATGCCCGGAGCCGTGCGCCTGCGTGGACAA
GTACGCTCACCAGTTCGCGGACTGCGCTTACAAAGAGTTGCGTGAGGTGCCGGAAGGACTGCCTGCCAACGTGA
CGACGCTTAGTCTGTCCGCGAACAAGATCACTGTGCTGCGGCGCGGGCCTTCGCCGACGTCACACAGGTCACG
TCGCTGTGGCTGGCGCACAATGAGGTGCGCACCGTGGAGCCAGGCGCACTGGCCGTGCTGAGTCAGCTCAAGAA
CCTCGATCTGAGCCACAACTTCATATCCAGCTTTCCGTGGAGCGACCTGCGCAACCTGAGCGCGCTGCAGCTGC
TCAAAATGAACCACAACCGCCTGGGCTCTCTGCCCCGGGACGCACTCGGTGCGCTACCCGACCTGCGTTCCCTG
CGCATCAACAACAACCGGCTGCGTACGCTGGCGCCTGGCACCTTCGACGCGCTTAGCGCGCTGTCACACTTGCA
ACTCTATCACAATCCCTTCCACTGCGGCTGCGGCCTTGTGTGGCTGCAGGCCTGGGCCGCGAGCACCCGGGTGT
CCTTACCCGAGCCCGACTCCATTGCTTGTGCCTCGCCTCCCGCGCTGCAGGGGGTGCCGGTGTACCGCCTGCCC
GCCCTGCCCTGTGCACCGCCCAGCGTGCATCTGAGTGCCGAGCCACCGCTTGAAGCACCCGGCACCCCACTGCG
CGCAGGACTGGCGTTCGTGTTACACTGCATCGCCGACGGCCACCCTACGCCTCGCCTGCAATGGCAACTTCAGA
TCCCCGGTGGCACCGTAGTCTTAGAGCCACCGGTTCTGAGCGGGGAGGACGACGGGGTTGGGCGGAGGAAGGA
GAGGGAGAAGGAGATGGGGATTTGCTGACGCAGACCCAAGCCCAAACGCCGACTCCAGCACCCGCTTGGCCGGC
GCCCCCAGCCACACCGCGCTTCCTGGCCCTCGCAAATGGCTCCCTGTTGGTGCCCCTCCTGAGTGCCAAGGAGG
CGGGCGTCTACACTTGCCGTGCACACAATGAGCTGGGCGCCAACTCTACGTCAATACGCGTGGCGGTGGCAGCA
ACCGGGCCCCAAAACACGCGCCTGGCGCCGGGGGAGAACCCGACGGACAGGCCCCGACCTCTGAGCGCAAGTC
CACAGCCAAGGGCCAGGGCCAACAGCGTCCTGCCTTCCAAACCCGAGGGCAAAATCAAAGGCCAAGGCCTGGCCA
AGGTCAGCATTCTCGGGGAGACCGAGACGGAGCCGGAGGAGGACACAAGTGAGGGAGAGGAGGCCGAAGACCAG
ATCCTCGCGGACCCGGCGGAGGAGCAGCGCTGTGGCAACGGGACCCCTCTCGGTACGTTTCTAACCACGCGTT
CAACCAGAGCGCAGAGCTCAAGCCGCACGTCTTCGAGCTGGGCGTCATCGCGCTGGATGTGGCGGAGCGCGAGG
CGCGGGTGCAGCTGACTCCGCTGGCTGCGCGCTGGGGCCCTGGGCCCGGCGGGGCTGGCGGAGCCCCGCGACCC
GGGCGGCGACCCCTGCGCCTACTCTATCTGTGTCCAGCGGGGGCGGCGCGGCAGTGCAGTGGTCCCGCGTAGA
GGAAGGCGTCAACGCCTACTGGTTCCGCGGCCTGCGGCCGGGTACCAACTACTCCGTGTGCCTGGCGCTGGCGG
GCGAAGCCTGCCACGTGCAAGTGGTGTTTTCCACCAAGAAGGAGCTCCCATCGCTGCTGGTCATAGTGGCAGTG
AGCGTATTCCTCCTGGTGCTGGCCACAGTGCCCCTTCTGGGCGCCGCCTGCTGCCATCTGCTGGCTAAACACCC
GGGCAAGCCCTACCGTCTGATCCTGCGGCCTCAGGCCCCTGACCCTATGGAGAAGCGCATCGCCGCAGACTTCG
ACCCGCGTGCTTCGTACCTCGAGTCCGAGAAAAGCTACCCGGCAGGCGGCGAGGCGGGCGGCGAGGAGCCAGAG
GACGTGCAGGGGAGGGCCTTGATGAAGACGCGGAGCAGGGAGACCCAAGTGGGGACCTGCAGAGAGAGGAGAG
CCTGGCGGCCTGCTCACTGGTGGAGTCCCAGTCCAAGGCCAACCAAGAGGAGTTCGAGGCGGGCTCTGAGTACA
GCGATCGGCTGCCCCTGGGCGCCGAGGCGGTCAACATCGCCCAGGAGATTAATGGCAACTACAGGCAGACGGCA
GGCTGAACCTCCGCCCGTCCGGCCCGCCCATTCCCGACCTCCACCTAGGGTGCCTGGGAGCAGCAGTCTAGGGC
TGGCAGGACTTATGTCCCCCGTCCCCAACCTTCACCTACTCCTCCCCCTTACTACTCCCAACCTTGACTACCA
GGGACTTCTATTAGGGAGTGGGCCGATTTCACCAGTCCCTGCTACCCACGGCTGCCATTCTCCCTGCGGCTGA
ATCCCCTTCCCCGCCAAGCACAGTGTTTATCTTACCCCATGCAAGACTCCACCCGCAGACGGTGGGCGATATCT
ATGTCCCTCCATTCCCGTCGCGATTATCTGCGAAATCCACCCCGCAGCCCGCCCCACCGTGGGCTCTGGAGCCA
GAGGAAACGAGCGAAGACTTTGGAAACCTCGCGGTAACGCGGTGGTTTCGGGGGCCAGCCAAGGCCAGTGGAGT
GCTGTGGGGTCCCACCTCGACCCCTCCTCCTCCCTTTCTTTCTTTCCTTTTTTTTTATTTTTTAATTTTATTTA
TTTATTTATTTATTTTTTGACGGAGTCTTGGTCTGTCGCCAGGCTGGAGTGCAGTGGCGCGATCTCGGCTCACT
GCATCTTCCGCCTCCCGGGTTCAAGCGATTCTCCTGCCTCAGCCTGCCTAGTAGCTGGGACTACAGGCGCGCGC
CACCACGACCAGCTAATTTCTTCTATTTTTAGTAGAGACGGGGTTTCACCATGTTGGCCAGGATGGTCTGGATC
TCTTGACCTCAGGTGATCCATCTGCCTCGGCCTCTCAAAGTGCTGGGATTACAGGCGTGAGGCACCGCGCCCGG
CCCCTCCTCCCTTTCAATCCCTACTCCCAGAAGCCGGGATTCGTGGCAACCCCTAGTTTTTAGTTCCAAAGCCT
CCTGCCGGCAGGGAACCAAATCCTTCTGTCCTCCCACCCCCACCCCACTTCTGGCCAGTTGGAGTCCAGCCCGG
TGCCTGGGGCGCCTTTCAGCTCCGCGCTCAGATTTTCCTGTTTTCGTTGTTTTCAAAGACAGCGACATTTCGGG
TCTGGTGCTAACACCCCCTTCCCAGCCTCTGGGAAAATCGAGTGTGTGTCGGGGGGTAGGGAGGGAATGCGT
TTTCTGTCGTCTCTCTCCTAACTTAAAGCGCCGCAGGACCGCGCGCCCCTTGGCGGCTGAGCCTGTGGACTTGG
TCGCGGGCCAATTTCGTTGTCCGTGTGTTGGGCTTTCCGGAGGTCTGTGCGCCCAACAGCGCCGCTCCCGCGGC
TCCACCCGACCCAGACCCTAGCTGGAAAGCGCCGGAGGCGGAGGAAGCTGACTGTGGCCTCCCGGGCGCGGCT
CTCTGGAGGGCTCGCGCCCTAGTTCGCACAAAGCCTGCTCGTGACTGTGCGACTGTGCGACGGGATCCGGATGG
AGCCGAGCCCCTCCGTCCTCGCGTCTCGGTCCTCGCGTCGCCCGCCCCACCCGCCCTGCTTCGGCGGGAATC
GTGTTTGCCCGGCGTGTAGTCCCTGACAAGCGTGCCCTGTAGGAGAAAAGTCTGTGTCCTGTGAAGTGTGACCG
TGTAGTGTAGGGGGCGGGCGGGGGGGCGGATGGGGCGGGAGGGGAGGGGAAGGGGAGGGGCGCGGCGGCGACT
CGGGGCGGGGTTCTTTTTTCCATTTTGAAAGAAAGCGTCGGGGTTTGGGGTGGGGGAGTTTCAGTCCTCGGGAT
CAGCCCTCTCCGCGAAGCGCAGCACAAGCGCGGGCCTGGGACGGAGTAGCCCCCGGAGCCCGTGCCCTTTTCT
AAACGCGTCTGTATGCAGTCAATAAAACAATCGATTTGAAA
```

FIGURE 68

MFPLRALWLVWALLGVAGSCPEPCACVDKYAHQFADCAYKELREVPEGLPANVTTLSLSANK
ITVLRRGAFADVTQVTSLWLAHNEVRTVEPGALAVLSQLKNLDLSHNFISSFPWSDLRNLSA
LQLLKMNHNRLGSLPRDALGALPDLRSLRINNNRLRTLAPGTFDALSALSHLQLYHNPFHCG
CGLVWLQAWAASTRVSLPEPDSIACASPPALQGVPVYRLPALPCAPPSVHLSAEPPLEAPGT
PLRAGLAFVLHCIADGHPTPRLQWQLQIPGGTVVLEPPVLSGEDDGVGAEEGEGEGDGDLLT
QTQAQTPTPAPAWPAPPATPRFLALANGSLLVPLLSAKEAGVYTCRAHNELGANSTSIRVAV
AATGPPKHAPGAGGEPDGQAPTSERKSTAKGRGNSVLPSKPEGKIKGQGLAKVSILGETETE
PEEDTSEGEEAEDQILADPAEEQRCGNGDPSRYVSNHAFNQSAELKPHVFELGVIALDVAER
EARVQLTPLAARWGPGPGGAGGAPRPGRRPLRLLYLCPAGGGAAVQWSRVEEGVNAYWFRGL
RPGTNYSVCLALAGEACHVQVVFSTKKELPSLLVIVAVSVFLLVLATVPLLGAACCHLLAKH
PGKPYRLILRPQAPDPMEKRIAADFDPRASYLESEKSYPAGGEAGGEEPEDVQGEGLDEDAE
QGDPSGDLQREESLAACSLVESQSKANQEEFEAGSEYSDRLPLGAEAVNIAQEINGNYRQTAG

Important features of the protein:

Signal peptide:

amino acids 1-19

Transmembrane domain:

amino acids 587-610

N-glycosylation sites.

amino acids 52-55, 121-124, 337-340, 364-367, 474-477, 563-566 cAMP- and cGMP-dependent protein kinase phosphorylation site.

amino acids 397-400

Casein kinase II phosphorylation sites.

amino acids 19-23, 202-205, 289-292, 246-249, 411-414, 431-434, 433-436, 440-443, 544-547, 583-586, 650-653, 700-703

N-myristoylation sites.

amino acids 15-20, 48-53, 165-170, 296-301, 351-356, 362-367, 390-395, 419-424, 514-519, 536-541, 557-562, 561-566, 610-615, 661-666, 716-721

Amidation site.

amino acids 522-525

Prokaryotic membrane lipoprotein lipid attachment sites.

amino acids 10-20, 603-613

FIGURE 69

```
GGCGGCGGGAGCAGCGAAGGGGGCGGCAGGGATCCTCCAGGCTGCCGGCTGGGAAGGCGTGG
GCGACCCGGTGTGTGGCGCGCCCAGAGCCCCGCGTTTCAGCCCTAGGGAAGGAAGCCAGTTG
AGGGAAGTTCTCCATGAATGTACGTCACAATGATGATGACCGACCAAATCCCTCTGGAACTG
CCACCATTGCTGAACGGAGAGGTAGCCATGATGCCCCACTTGGTGAATGGAGATGCAGCTCA
GCATGTTATTCTCGTTCAAGTTAATCCAGGTGAGACTTTCACAATAAGAGCAGAGGATGGAA
CACTTCAGTGCATTCAAGGACCTGCTGAAGTTCCCATGATGTCACCCAATGGATCCATTCCT
CCCATTCATGTGCCTCCAGGTTATATCTCACAGGTGATTGAAGATAGTACTGGAGTCCGCCG
GGTGGTGGTCACACCCCAGTCTCCTGAGTGTTATCCCCCAAGCTACCCCTCAGCCATGTCTC
CAACCCATCATCTCCCTCCCTATCTGACTCACCATCCACATTTTATTCATAACTCACACACG
GCTTACTACCCACCTGTTACCGGACCTGGAGATATGCCGCCTCAGTTTTTTCCCCAGCATCA
TCTTCCCCACACAATATATGGTGAGCAAGAAATTATACCATTTTATGGAATGTCAAGCTACA
TCACCCGAGAAGACCAGTACAGCAAGCCTCCGCACAAAAAACTGAAAGACCGCCAGATCGAT
CGCCAGAACCGCCTCAACAGCCCTCCTTCTTCTATCTACAAAAGCAGCTGCACAACAGTATA
CAATGGCTATGGGAAGGGCCATAGTGGTGGAAGTGGCGGAGGCGGCAGCGGTAGTGGTCCCG
GAATTAAGAAAACAGAGCGACGAGCAAGAAGCAGCCCAAAGTCGAATGATTCAGACTTGCAA
GAATATGAGTTGGAAGTAAAGAGGGTGCAAGACATTCTTTCGGGAATAGAGAAACCACAGGT
TTCTAATATTCAGGCAAGAGCAGTTGTGTTGTCCTGGGCTCCCCCTGTTGGACTTTCCTGTG
GACCCCACAGTGGTCTTTCCTTCCCCTACAGTTACGAGGTGGCCTTATCAGACAAAGGACGA
GATGGAAAATACAAGATAATTTACAGTGGAGAAGAATTAGAATGTAACCTGAAAGATCTTAG
ACCAGCAACAGATTATCATGTGAGGGTGTATGCCATGTACAATTCCGTAAAGGGATCCTGCT
CCGAGCCTGTTAGCTTCACCACCCACAGCTGTGCACCCGAGTGTCCTTTCCCCCCTAAGCTG
GCACATAGGAGCAAAAGTTCACTAACCCTGCAGTGGAAGGCACCAATTGACAACGGTTCAAA
AATCACCAACTACCTTTTAGAGTGGGATGAGGGAAAAAGAAATAGTGGTTTCAGACAGTGCT
TCTTCGGGAGCCAGAAGCACTGCAAGTTGACAAAGCTTTGTCCGGCAATGGGTACACATTC
AGGCTGGCCGCTCGAAACGACATTGGCACCAGTGGTTATAGCCAAGAGGTGGTGTGCTACAC
ATTAGGAAATATCCCTCAGATGCCTTCTGCACCAAGGCTGGTTCGAGCTGGCATCACATGGG
TCACGTTGCAGTGGAGTAAGCCAGAAGGCTGTTCACCCGAGGAAGTGATCACCTACACCTTG
GAAATTCAGGAGGATGAAAATGATAACCTTTTCCACCCAAAATACACTGGAGAGGATTTAAC
CTGTACTGTGAAAAATCTCAAAAGAAGCACACAGTATAAATTCAGGCTGACTGCTTCTAATA
CGGAAGGAAAAGCTGTCCAAGCGAAGTTCTTGTTTGTACGACGAGTCCTGACAGGCCTGGA
CCTCCTACCAGACCGCTTGTCAAAGGCCCAGTTACATCTCATGGCTTTAGTGTCAAATGGGA
TCCCCCTAAGGACAATGGTGGTTCAGAAATCCTCAAGTACTTGCTAGAGATTACTGATGGAA
ATTCTGAAGGTGAAGTTTTTGGCAATTGTTTATTCAAATCCAATAGCAAGCTCTGTTTTCT
AATATAGTAAATGTCTTTATAGTAATAGTGAGTAATCATTAATTCTAAAGATAGAATTATTA
TTACAATAAACAAACTTTAGTCACATATTGGCAGTTTTTCTATTTCAAACACAGCACCAGAG
ATCAGAGTCTACTTGAAACTTACATTTGTGTTATTTAACAATTTTTCTGTATCTTTTTCATT
GGTGTTTTGTTTTGTTTATCTTTTGTTTTTGTTTCTTTGGTTTGGTTTGTTTTTGTTTTGTT
TTTTGAGATACGATCTCTGTCACACAGGCTGGAGGGCAGTGGCACAGACATGGCCCATTGCA
GTCTCAGACTCCTGGGCTTAAGTGACTCTTCTGCCACAGAAGATGAGGAAGAATACATTTTT
CATAGTGATGGGGTCTCACTATGTTATCTAGGCTGGTCTCAAACTCCTGGCCTCAAGCAACC
CTCCACCTTGGCCTCCCAAAGTGCTGGGACTATAGACATGAATCACCACACTCAGCTTCCAT
GTCTTTTTATGAACTAGGGTTCCTAATTAATCAGATAAATTTGGTATTTTCATCTCCTAACT
TGCCATATGTTTTCTGGAAATTCTTATAAGCAGCCGAGAGTGGTGGCTCACGCTGTAGTCCC
AGCACTTTGGGAGGCTGAGGTGGGTGGTCAGGAGATCAAGACCATCCTGGCCAACATGGTGA
AACCCCGTCTCTACTAAAAATACAAAAATTAGCTGGGTGTGGTGGCAGGCACCTGTAGTCCC
AGCTACTTGGGAGGCTGAGGCAGAAGAATTGCTTGAACCCAGCAGGCGGAGGTTGCAGTGAG
CTGAGATTGCACCACTGCACTCCAGCCTGGTGACAGAGTGAGACTCTGTCTCAAAAAAAAAAAA
```

FIGURE 70

MMMTDQIPLELPPLLNGEVAMMPHLVNGDAAQHVILVQVNPGETFTIRAEDGTLQCIQGPAE
VPMMSPNGSIPPIHVPPGYISQVIEDSTGVRRVVVTPQSPECYPPSYPSAMSPTHHLPPYLT
HHPHFIHNSHTAYYPPVTGPGDMPPQFFPQHHLPHTIYGEQEIIPFYGMSSYITREDQYSKP
PHKKLKDRQIDRQNRLNSPPSSIYKSSCTTVYNGYGKGHSGGSGGGGSGSGPGIKKTERRAR
SSPKSNDSDLQEYELEVKRVQDILSGIEKPQVSNIQARAVVLSWAPPVGLSCGPHSGLSFPY
SYEVALSDKGRDGKYKIIYSGEELECNLKDLRPATDYHVRVYAMYNSVKGSCSEPVSFTTHS
CAPECPFPPKLAHRSKSSLTLQWKAPIDNGSKITNYLLEWDEGKRNSGFRQCFFGSQKHCKL
TKLCPAMGYTFRLAARNDIGTSGYSQEVVCYTLGNIPQMPSAPRLVRAGITWVTLQWSKPEG
CSPEEVITYTLEIQEDENDNLFHPKYTGEDLTCTVKNLKRSTQYKFRLTASNTEGKSCPSEV
LVCTTSPDRPGPPTRPLVKGPVTSHGFSVKWDPPKDNGGSEILKYLLEITDGNSEGEVFGNC
FIQIQ

Important features of the protein:

N-glycosylation sites.

amino acids 69-73, 254-258, 401-405

Glycosaminoglycan attachment sites.

amino acids 229-233, 234-238, 236-240 cAMP- and cGMP-dependent protein kinase phosphorylation sites.

amino acids 416-420, 535-539

Tyrosine kinase phosphorylation site.

amino acids 319-326

N-myristoylation sites.

amino acids 52-58, 227-233, 228-234, 230-236, 231-237, 232-238, 235-241, 239-245, 402-408, 610-616

Amidation site.

amino acids 414-418

Prokaryotic membrane lipoprotein lipid attachment site.

amino acids 290-301

ATP/GTP-binding site motif A (P-loop).

amino acids 546-554

CUB domain proteins profile.

amino acids 294-301

FIGURE 71

```
AAGTCATTCAGTGGATGTGATCTTGGCTCACAGGGGACGATGTCAAGCTCTTCCTGGCTCCTTCTCAGCCTTGT
TGCTGTAACTGCTGCTCAGTCCACCATTGAGGAACAGGCCAAGACATTTTTGGACAAGTTTAACCACGAAGCCG
AAGACCTGTTCTATCAAAGTTCACTTGCTTCTTGGAATTATAACACCAATATTACTGAAGAGAATGTCCAAAAC
ATGAATAATGCTGGGGACAAATGGTCTGCCTTTTTAAAGGAACAGTCCACACTTGCCCAAATGTATCCACTACA
AGAAATTCAGAATCTCACAGTCAAGCTTCAGCTGCAGGCTCTTCAGCAAAATGGGTCTTCAGTGCTCTCAGAAG
ACAAGAGCAAACGGTTGAACACAATTCTAAATACAATGAGCACCATCTACAGTACTGGAAAAGTTTGTAACCCA
GATAATCCACAAGAATGCTTATTACTTGAACCAGGTTTGAATGAAATAATGGCAAACAGTTTAGACTACAATGA
GAGGCTCTGGGCTTGGGAAAGCTGGAGATCTGAGGTCGGCAAGCAGCTGAGGCCATTATATGAAGAGTATGTGG
TCTTGAAAAATGAGATGGCAAGAGCAAATCATTATGAGGACTATGGGATTATTGGAGAGGAGACTATGAAGTA
AATGGGGTAGATGGCTATGACTACAGCCGCGGCCAGTTGATTGAAGATGTGGAACATACCTTTGAAGAGATTAA
ACCATTATATGAACATCTTCATGCCTATGTGAGGGCAAAGTTGATGAATGCCTATCCTTCCTATATCAGTCCAA
TTGGATGCCTCCCTGCTCATTTGCTTGGTGATATGTGGGGTAGATTTTGGACAAATCTGTACTCTTTGACAGTT
CCCTTTGGACAGAAACCAAACATAGATGTTACTGATGCAATGGTGGACCAGGCCTGGGATGCACAGAGAATATT
CAAGGAGGCCGAGAAGTTCTTTGTATCTGTTGGTCTTCCTAATATGACTCAAGGATTCTGGGAAAATTCCATGC
TAACGGACCCAGGAAATGTTCAGAAAGCAGTCTGCCATCCCACAGCTTGGGACCTGGGGAAGGGCGACTTCAGG
ATCCTTATGTGCACAAAGGTGACAATGGACGACTTCCTGACAGCTCATCATGAGATGGGGCATATCCAGTATGA
TATGGCATATGCTGCACAACCTTTTCTGCTAAGAAATGGAGCTAATGAAGGATTCCATGAAGCTGTTGGGGAAA
TCATGTCACTTTCTGCAGCCACACCTAAGCATTTAAAATCCATTGGTCTTCTGTCACCCGATTTTCAAGAAGAC
AATGAAACAGAAATAAACTTCCTGCTCAAACAAGCACTCACGATTGTTGGGACTCTGCCATTTACTTACATGTT
AGAGAAGTGGAGGTGGATGGTCTTTAAAGGGGAAATTCCCAAAGACCAGTGGATGAAAAAGTGGTGGGAGATGA
AGCGAGAGATAGTTGGGGTGGTGGAACCTGTGCCCCATGATGAAACATACTGTGACCCCGCATCTCTGTTCCAT
GTTTCTGATGATTACTCATTCATTCGATATTACACAAGGACCCTTTACCAATTCCAGTTTCAAGAAGCACTTTG
TCAAGCAGCTAAACATGAAGGCCCTCTGCACAAATGTGACATCTCAAACTCTACAGAAGCTGGACAGAAACTGT
TGTAAGAAATACCTCAAAATGTTGAACCTCTCCTAGTATTCAGTATTACTCATTTCCATGCCTAGGTTTGTATT
TGATTTCTTTGTTCTAAAAAGAAAATTTTATGGCCTCAAAATGTCCTCATTTACAAACCAAACATTTAATTTGT
GGTCAGACAGGAACCTAGACCATACAACAATTGGGTGGGCCACCTCTTTTCTCCCTATCATAACTACAGCCCTC
TCTTCCTGGTAATTGGAAGGAAAGAGCGGTTTAGGGTGGAATATATCTGTTAATATGCATTCTTTTCTTATCTG
CCAGAAGCAAATTTAGCCAAGTCAAAGAGAAGAAACCATAGATCATAGATGTAAATATATGTACATCTGGAACC
CCTCAAAAGGCCCTGAACCCCCTTTTTTGTGTAGCAATATGCTGAGGCTTGGAAAATCAGAACCCTGGACCCT
AGCATTGGAAAATGTTGTAGGAGCAAGAACATGAATGTAAGGCCACTGCTCAACTACTTTGAGCCCTTATTTAC
CTGGCTGAAAGACCAGAACAAGAATTCTTTTGTGGGATGGAGTACCGACTGGAGTCCATATGCAGACCCAAAGC
ATCAAAGTGAGGATAAGCCTAAAATCAGCTCTTGGAGATAAAGCATATGAATGGAACGACAATGAAATGTACCT
GTTCCGATCATCTGTTGCATATGCTATGAGGCAGTACTTTTTAAAAGTAAAAAATCAGATGATTCTTTTTGGGG
AGGAGGATGTGCGAGTGGCTAATTTGAAACCAAGAATCTCCTTTAATTTCTTTGTCACTGCACCTAAAAATGTG
TCTGATATCATTCCTAGAACTGAAGTTGAAAAGGCCATCAGGATGTCCCGGAGCCGTATCAATGATGCTTTCCG
TCTGAATGACAACAGCCTAGAGTTTCTGGGGATACAGCCAACACTTGGACCTCCTAACCAGCCCCCTGTTTCCA
TATGGCTGATTGTTTTTGGAGTTGTGATGGGAGTGATAGTGGTTGGCATTGTCATCCTGATCTTCACTGGGATC
AGAGATCGGAAGAAGAAAAATAAAGCAAGAAGTGGAGAAAATCCTTATGCCTCCATCGATATTAGCAAAGGAGA
AAATAATCCAGGATTCCAAAACACTGATGATGTTCAGACCTCCTTTTAGAAAAATCTATGTTTTTCCTCTTGAG
GTGATTTTGTTGTATGTAAATGTTAATTTCATGGTATAGAAAATATAAGATGATAAAGATATCATTAAATGTCA
AAACTATGACTCTGTTCAGAAAAAAAATTGTCCAAAGACAACATGGCCAAGGAGAGAGCATCTTCATTGACATT
GCTTTCAGTATTTATTTCTGTCTCTGGATTTGACTTCTGTTCTGTTTCTTAATAAGGATTTTGTATTAGAGTAT
ATTAGGGAAAGTGTGTATTTGGTCTCACAGGCTGTTCAGGGATAATCTAAATGTAAATGTCTGTTGAATTTCTG
AAGTTGAAAACAAGGATATATCATTGGAGCAAGTGTTGGATCTTGTATGGAATATGGATGGACACTTGTAAGG
ACAGTGCCTGGGAACTGGTGTAGCTGCAAGGATTGAGAATGGCATGCATTAGCTCACTTTCATTTAATCCATTG
TCAAGGATGACATGCTTTCTTCACAGTAACTCAGTTCAAGTACTATGGTGATTTGCCTACAGTGATGTTTGGAA
TCGATCATGCTTTCTTCAAGGTGACAGGTCTAAAGAGAGAAGAATCCAGGGAACAGGTAGAGGACATTGCTTTT
TCACTTCCAAGGTGCTTGATCAACATCTCCCTGACAACACAAAACTAGAGCCAGGGCCTCCGTGAACTCCCCA
GAGCATGCCTGATAGAAACTCATTTCTACTGTTCTCTAACTGTGGAGTGAATGGAAATTCCAACTGTATGTTCA
CCCTCTGAAGTGGGTACCCAGTCTCTTAAATCTTTTGTATTTGCTCACAGTGTTTGAGCAGTGCTGAGCACAAA
GCAGACACTCAATAAATGCTAGATTTACAAAA
```

FIGURE 72

MSSSSWLLLSLVAVTAAQSTIEEQAKTFLDKFNHEAEDLFYQSSLASWNYNTNITEENVQNM
NNAGDKWSAFLKEQSTLAQMYPLQEIQNLTVKLQLQALQQNGSSVLSEDKSKRLNTILNTMS
TIYSTGKVCNPDNPQECLLLEPGLNEIMANSLDYNERLWAWESWRSEVGKQLRPLYEEYVVL
KNEMARANHYEDYGDYWRGDYEVNGVDGYDYSRGQLIEDVEHTFEEIKPLYEHLHAYVRAKL
MNAYPSYISPIGCLPAHLLGDMWGRFWTNLYSLTVPFGQKPNIDVTDAMVDQAWDAQRIFKE
AEKFFVSVGLPNMTQGFWENSMLTDPGNVQKAVCHPTAWDLGKGDFRILMCTKVTMDDFLTA
HHEMGHIQYDMAYAAQPFLLRNGANEGFHEAVGEIMSLSAATPKHLKSIGLLSPDFQEDNET
EINFLLKQALTIVGTLPFTYMLEKWRWMVFKGEIPKDQWMKKWWEMKREIVGVVEPVPHDET
YCDPASLFHVSDDYSFIRYYTRTLYQFQFQEALCQAAKHEGPLHKCDISNSTEAGQKLL

Important features of the protein:

Signal peptide:

amino acids 1-17

N-glycosylation sites.

amino acids 53-57, 90-94, 103-107, 322-326, 432-438, 546-550

N-myristoylation sites.

amino acids 260-266, 286-292, 395-401

Cell attachment sequence.

amino acids 204-207

Neutral zinc metallopeptidases, zinc-binding region signature.

amino acids 371-381

FIGURE 73

CCCACGCGTCCGAGCGGGGTGGACAAGTGGCGTGTGTGCTGCGACCCCGAGGGAAG<u>ATG</u>AACG
GGACGCGGAACTGGTGTACCCTGGTGGACGTGCACCCAGAGGACCAGGCGGCGGCGGGCAGGA
AGACCTATGCCATGGTGTCCAGCCACTCAGCTGGTCATTCTCTGGCTTCAGAACTGGTGGAGT
CCCATGATGGACATGAGGAGATCATTAAGGTGTACTTGAAGGGGAGGTCTGGAGACAAGATGA
TTCACGAGAAGAATATTAACCAGCTGAAGAGTGAGGTCCAGTACATCCAGGAGGCCAGGAACT
GCCTACAGAAGCTCCGGGAGGATATAAGTAGCAAGCTTGACAGGAACCTAGGAGATTCTCTCC
ATCGACAGGAGATACAGGTGGTGCTAGAAAAGCCAAATGGCTTTAGTCAGAGTCCCACAGCCC
TGTACAGCAGCCCACCTGAGGTGGACACCTGTATAAATGAGGATGTTGAGAGCTTGAGGAAGA
CGGTGCAGGACTTGCTGGCCAAGCTTCAGGAGGCCAAGCGGCAACACCAGTCAGACTGTGTGG
CTTTTGAGGTCACACTCAGCCGGTACCAGAGGGAAGCAGAACAAAGTAATGTGGCCCTTCAGA
GAGAGGAGGACAGATGTCCAGAG<u>TGA</u>TTGGAGAATGTCCTGGGGGAATGAAGTTCCTTCCACA
AACACAGCTCAGTTCTTAGCAACAAACTGTTTGTTTTTCTACTTGCTCCATCTGCAGCCTACG
CTGCCCTGGCCTCCTGCAGACAGATAGTGGGGTTACCTGGCAAGGCCTGGTGAGAGCCAGTGA
ACCTAAGCTTTGACTGGGTGGCCTTGTCTTTCTGGGGAGGAGGGAATGTACATTCAGGGAGTA
GCCTTTTGCGGAAAAATTCTCTAGGGCTACAGACAGTCATGTGTGACTTCTCTCTGCTGTGAA
AACTCCCAGAGTCTCTTTAGGGATTTTCCCTAAGGTGTACCACCAGGCACACCTCAGTCTTCT
TGACCCAGAGCCTGAAAACTGTTTTCACTGGGTTCCACCAGTCCCAGCAAAATCCTCTTTGTA
TTTATTTTGCTAAGTTATTGGTGGTTTTGCTTACATCTCATGATTGATATAATACCAAAGTTC
TATAGCCTTCTCTTGCAGTATTTGGATTTGCTTGAAACCGGGAAAACTGTTCCCATTAGGCTT
GTTAATGTCAGAGTGACACTATTATGAATCTTTCTCTCCCTTTCCTCTGCCTGTTTCTTCTCT
CTTTCTCCTTCAAACTTGCTCTGCAGCTAAGGAAGGTGAGTCTACTTTCCCTGAGGCTTTGGG
GTCAGAGTATATGTTGTTTGGAGAAAGAGGGCAATCAGGACTCTTCTGGGACCCAGATGAGTT
CTTCACTAGCCCTTCTGAACCCCTTGCTCCATAATTGGTCTTTTATCCTGGCTCTGAATGACC
CTGCAGGTCATCATGGTTTTCTTTTTTTATTGTTTTTTTTTTTTCTGAGACAGAGTCTCACT
CTGTCACCCAGGCTGGAGTGCAGTGGCGCGATCTCAGCTCACTGCAACCTCTGCCTCCCGGAT
TTAAGCGATTCTTCTGCCTCAGCCTCCCGAGTAGCTGGGACTACAGGTGTGCCACCACGCCTG
GCTGATTTTTGTATTTTTAGTAGAGATGGGGTTTCACCATACTGGCTAGGCTGGTCTCGAATT
CCTGACCTCAGGTGATCCACCCACCTCGGCTTCCCAAAGTGCTAGGATTATAGGCTTGAGCTA
CTGCGCCCGGCCCATGGTGTTTTTCTTTAGGGCTCTTCCTACAGCCTTGAGAAGTAGATAGGC
ATCAGAGTATGGTACTATAGGAATCAGAAAAATTCAAAACAAATGTGGATTAAGTGTTTAGGC
TCTATGTGGCTCACGCAGCCAGAATCCTTAAGTCTGTGTGTTTCTGTGTCTCAAGACTGGGCT
CACATTCTGGCTTTGTCCATAACAATGCTCTGGGATTTCAGGGAGTTCCCTCATTTGTAAAAT
GAGGGGGTCAGAGCAGGTGATATCCATGTTTCTTCCCTTTCTGATATTGTTGTCTGTGGCATA
TTCTTTGTATGGCGAATTTAATAAATTATATTAATGTGTCA

FIGURE 74

MNGTRNWCTLVDVHPEDQAAAGRKTYAMVSSHSAGHSLASELVESHDGHEEIIKVYLKGRSGD
KMIHEKNINQLKSEVQYIQEARNCLQKLREDISSKLDRNLGDSLHRQEIQVVLEKPNGFSQSP
TALYSSPPEVDTCINEDVESLRKTVQDLLAKLQEAKRQHQSDCVAFEVTLSRYQREAEQSNVA
LQREEDRCPE

Important features of the protein:

Signal peptide:

amino acids 1-39

N-glycosylation site.

amino acids 2-6

Amidation site.

amino acids 21-25

FIGURE 75

```
GCTTGCACACATGGCTCCGGAGGCTCCGGTTGCCCATCCGAGCCCCTGCCAGGCTCTAACGTTCCCAACTGACAA
CACCAGTAACTAAATATAGGAGCAGATGGTGGGGACGGGCTGTCGCAGCGGCTCCTTTGCAGAGGTCTCCGGACT
GCAGATAAGGCTCAGGCCCTTTTGTGAGAAGCAGACCAGCCTGGGGGCTGGCGGCAGGACACCTGTGTCTGCATG
CTGAAGAAGATGGGTGAGGCCGTGGCCAGAGTAGCAAGGAAGGTCAACGAGACGGTGGAGAGCGGCTCTGACACT
CTGGACCTGGCCGAGTGCAAGCTGGTCTCCTTTCCCATTGGCATCTACAAGGTCCTGCGGAATGTCTCTGGCCAG
ATCCACCTCATCACCCTGGCTAACAACGAGCTTAAGTCCCTCACCAGCAAGTTCATGACCACATTCAGTCAGCTC
CGAGAGCTCCACCTGGAGGGGAACTTCCTACACCGCCTCCCCAGCGAGGTCAGTGCCCTGCAGCACCTCAAGGCC
ATTGACCTGTCCCGGAACCAGTTCCAGGACTTCCCTGAGCAGCTTACCGCCCTGCCGGCGCTGGAGACCATCAAC
CTGGAGGAGAACGAGATCGTAGATGTGCCCGTGGAGAAGCTGGCCGCCATGCCAGCCTTGCGCAGCATCAACCTC
CGCTTCAACCCACTCAACGCCGAGGTGCGCGTGATCGCCCCGCCGCTCATCAAGTTTGACATGCTCATGTCTCCG
GAAGGCGAAGAGCCCCCCTACCTTAGGCCACCCTCCTCATGCCCACCCAGCAAGGGACAGAGGCCACAGGCCTG
GAACCCTGGAAGGGAGGGAGGCCCATGGGAGGCCAAGCCTGGGGCTGGGGCGGGTGGGCCGAGCAGCACGTGG
TGGGTGGGGTGCAGCTGGTCTGGATAGATAGCTTACAGCAGTAGTGGGCTCTGGAATGCCCAAGGGAAGAGGCAA
GGTGGGGCCTGCAGCCTGGACTCGGCACTCACAGCTGCTGTGCAAACTCAGGCAGATCTCCTGCCCTCTCTGAGC
CTTGTCACTTGAAAAAAACAGGACCCTTTCCCTCCTTTGGGCTCCCTGGAGGTTTTTAAGCAGTACGTGCCTCCA
AGTTACCTCCAGATCAGCAGGCACAGGTGGGCATTGCCAGGTATTTTCTGAGCCCCTGCGGGTTTGAGGCCTTGT
TTTTAGTGCTGAGAGCCAGTTGCTGCCCTGAGAAGAGAAGACAACCTCCATCTATTTATTGCTTCCTGAGAACTG
ACCTGGATGCGGCCCTCTGCAGGGCCCAGTCTTCAGTCCTGTGGTCCCTGGACTGGTGGGAACCTGAACTAGGAG
TCCTGGGAGAGCTGTGGTGGGAATATGGGCTGGCACTGCTGCAGGGCAAGAACATTCATGTAGGAGCCCGAGGAC
CANCANGCTGGGAATGGGGAGCAAGTCACGTCAGCTCTGTCATTCCCCACAGTTAACAAATTGGCGGGGTGGGAA
GTCCTGAGTGCTCCGTCCCTCTAGCATCACTCCTGAGCTGCGGGAGAGGTGGCCCAGAGAACAGCAGAGTCAGTT
ACACCTGCAGCTCTTGTCTAAAGTGATTAGATGGCCACCCTCACCACTGTCCAGTCCAGCAGCAGCCTGGCTGCC
TTGTCATGGCCTCCTGGGGGCAGAAGGCGATGTGGACCACGGGATTTGTAGCCAGCCAGCTCCCAGGCCAACGCC
CAAAGCCCTGATGACCTGGTTCTTCTGAGGCCCTCAACCTGGCATCTTAGGGTATGGTCAGGCAACAGGGTGACC
AGCTGTCCTGGTTTCCCAGGACATGGAACTTTCAATGCTAAAACTGGGACATTACCCAGCAAGTGGGGATGGTTG
GTCCCCTACCAGGAGAGGGCCTGGGGCTCTTGCTTCCCGAGAACGCCTGTGGCTTGAAGAACCTTGACTGCTTGG
TCCTCAGGTATCTACCTCCCACCTTCTCCTCATCTGTGGAGCAAGCCAACTCAGTGCCCCAGACCCCACCTGATC
TGCATCTTTGTTTGCTCCAGAGACACCTGAGGCCCCAGAGCTTGAGGCAAAGCCAGGCCGTCCAAATCCTGTGTG
CCGTGGACGAGTGGCCACTTTACTACTCCTAAGGCTAAGATGTTGAGAGCTCAGACCACTGCTCAGAGCAGTAAT
CCCTGCTCAGAATGCTCCCAGTTCCCTCGTCCCTGCCCAGGTCTCTTGTCTCTTGGGAAGGAACTGATAGGTCGG
GCCATTGTTGGGCCATCACTGAGCGCTCAGTATCTCAAGAGACTCTGTTCATTCTGCTCGTATCCCAAGGCCTGG
TTGGTCAAACTCTGGGCAAAGGGTTTTCAGGATGAGGAGGTCAAGACAGGATGTCCAGAGCTACCGAGTTCATCT
GTGGGTGTTGGGGGCAAGTGGGGCTGAAGTCCTGTGCAGGCTGCGCTGGCCCACCTGCCTTGTGCCCTGGAGT
GGGGTTTCTCCTTGTTGAAGAAGAGGCATCCTTCTCTGATGTGCACAAACACAATGTATGACCAGAGCCTTGCAA
CTCAAAGTGTGGTCTGTGGACCAGCAGCGGCAGTGACACCTGGGAGCTTGTTAGGAATGCAGAGTCTAGGCCTCA
CCCTATACCTCCCGACTCAGACCCTGCATTTTAGCAAGACCCCCAGCTGATTCCTATAAGCACTTTAGAGTTTGA
GAAGCAAGGACCTAGGCTGGGATGTCCTCCGAGCAGAGGGTGAAGTTTCTCTCAGTTCTCTCCCTGCCACTTCC
AGGGATCTGAGCCTGTGTTCAGCCTCCTCCCTAACCCACCCTGGGAGACACTTGGCCTGTTAGATTGTTCCAGAG
TCTGCATGGCACTCCTGAAGAAGGGAGTGTGACCTGCAGTCACCAGGAGATGAGGGTTAGGTGTGCCCAGCCCTC
CAGACCCGGCCTTTCTGGTTAACCCCTGCATGCCAAGCTGCCTGCTGCCCCAGGTCCTCACCTCAGGCCTTTGAA
GGGGCAGCTTCTGGAAGTTGTTTTCTCCTCTGCTTGGAGAGTTTGCCCTTGTCTGTCTTGGAAAGTGTGGGCAGC
CACAGATGCCCCCAAATCAGAGCTCACAGTGAGTGAGCCCCTAAGCTTCAGTCTGCAATAAAGAATGCATTGGTT
TCAAAAAAAAAAAAAAAAAAAAAAAAAAAAAAAAAAAAAAAAAAA
```

FIGURE 76

MLKKMGEAVARVARKVNETVESGSDTLDLAECKLVSFPIGIYKVLRNVSGQIHLITLANNELK
SLTSKFMTTFSQLRELHLEGNFLHRLPSEVSALQHLKAIDLSRNQFQDFPEQLTALPALETIN
LEENEIVDVPVEKLAAMPALRSINLRFNPLNAEVRVIAPPLIKFDMLMSPEGARAPLP

Important features of the protein:
N-glycosylation sites.
amino acids 17-21, 47-51

FIGURE 77

```
CACCAACAAGCAATCGTTCATGAGAAAGCCGTGCACCCGCTGCAGTTGGGCCATGTGGTCCGCATCGTATTCCAC
TAGGTCCCCATTGTACACCAAGTACTGTCCCGGCGTCTCCAGCAGATGCCTGCAGCCTTCCACCTTCTCAAGCAG
GGTGGTGTGAGTGCGCTGCTTTCCTTCCTCGCCTGGACCGGAGCCGTCGCGGGAGGCACCCCCGGGGGTGGAGAA
AAAGCCGGCCTGGCCTCGGAGGTGGTCTCGGCCCCCCCGCCCACCGACTCCCTCCTCCCCTCCAGAGGCGGCGGC
GGCTCCGGCGGCAGCAGCGGCAGGCAGCAACGTAAGCGGGATGCTCTCCAGGCTGCTTTTCTGCTCGGTCAGCAA
ATGGCTGAGCTGGTACATCTCGCTCTCCAGGTAGGAGATCTCGCGGGCCGTCTCTATGAACTGCCGGTAGTTCTG
GTAGACGTTGCGCTTCAGGTTCTGCGCCGTCTCCTCCGCCAGCGCCTGGATGCGCTGCCGGTGCTCCTGGAGGTC
CCGGTCCCCATCCGACTGCTGCGAGAGCTGCTTCACGTACAGCCGCGCCTCAAAACCCCCTGACTCCAGCTGCCG
ACGCAGGCGGCTCGCCCCACTGTCCGACATCGCCATCGCCATTTCTCTCCGGGTCTCACGCACTCACTGTCACTA
TCGGCGCCGCAGCCGCCGCGGCTGTCTAGACCCACCCAAGGCCAACCGAGCTCCTGGGCTGAGGAAGCAGGAATG
GGAACGAGACGAGTACGCCTGCGCCGGGTCTGAGCGTCAGACACTGCGCCTGCGCAAGTGGGCCGAGCGCAGACA
TTGCGCCTGCGCAGCAATGCCATCGGTTAAAGCGCATGCGCAAGATGAGCTATTGCGGAAGTGAGGGGAGGGAGA
GGCCGAGAGAAATTTCGGTACTGCGCATGAACCGAGCGTGACGTTGAGGTTTGAAATAACCGGCAAAGAGTAAAG
GCTGAAACTAGCTTCCTGAAAGCTTCGTAGGGCCCGAGCCCTGTGAGCCCAGGTTCTGCGCCCACTAGGAGGTGT
CATGCTGACTGCTTTTTTTAAAGCCCTAGAATCCTTGGCTTCGGCGTTTGGGGTAAGCTCCGTTCTCGTTCTCAA
GCGCGTTTCCGCGAACTCTCGCGGGATTGACGGGCCGTCTCGAGAGCCGGCATCTCCTAGGAGCTAGTCCTGGTC
CTCGGCTAGGCGGCTTGGGGTCGCGGCGTAACTGGGGAGCCAGCCTGACGCCGGCGGACCCCGCCTGTGATCCTG
GCAACGATGGATGATGACTTGATGTTGGCACTGCGGCTTCAGGAGGAGTGGAACTTGCAGGAGGCGGAGCGCGAT
CATGCCCAGGAGTCCCTGTCGCTAGTGGACGCGTCGTGGGAGTTGGTGGACCCCACACCGGACTTGCAGGCACTG
TTTGTTCAGTTTAACGACCAATTCTTCTGGGGCCAGCTGGAGGCCGTCGAGGTGAAGTGGAGCGTGCGAATGACC
CTGTGTGCTGGGATATGCAGCTATGAAGGGAAGGGTGGAATGTGTTCCATCCGTCTCAGCGAACCCCTTTTGAAG
TTGAGGCCAAGAAAGGATCTTGTAGAGACCCTCCTGCATGAAATGATACATGCCTATTTATTTGTCACTAATAAC
GACAAAGACCGAGAAGGGCATGGTCCAGAATTTTGTAAACATATGCATCGCATCAACAGCCTGACTGGAGCCAAT
ATAACGGTATACCATACTTTTCACGATGAGGTGGATGAGTATCGGCGACACTGGTGGCGCTGCAATGGGCCGTGC
CAGCACAGGCCACCGTATTACGGCTATGTCAAACGAGCTACTAACAGGGAACCCTCTGCTCATGACTATTGGTGG
GCTGAGCACCAGAAAACCTGTGGAGGCACTTACATAAAAATCAAGGAACCAGAGAATTACTCAAAAAAAGGCAAA
GGAAAGGCAAAACTAGGAAAGGAACCAGTATTGGCCGCAGAGAATAAAGGTACCTTCGTGTATATTCTTCTGATT
TTTATGTGACCATAGCTATGATGTAAAGACAATACTGTCCTTCAGAGAACTGGTATTAAGATAAACTTAAGGATC
GTTTCTGGTGTAGAAGTCTTCAAGTGTAGACTTAAGGAAAAAATCCCACTGTCCATGAAATGATGGTAGGAAAAC
AGACTTTGCTCTGTACAGAAGTAAGTAAAAGTAGGAATAGTTTCCATGGATATTTTATTTTATTAACTTTTTT
CAGTTTCTTTTTATTCAAAGAAACAAAATTCAATCTCTGATAATATTTGAGGTAAAGTTCCTTTCCCTATCTTGA
CTCACTGAGTTATTAGGAAACAGAAGGCAAAAGATTGTCAAAATAAAAACAATAATTCAAGTAACAATGCCCGG
AATATACGTCCTAACTACACCCCTTCCTATCAGCTGGATTCTATCCAAGTGACTCTATTGATGTATGTATGTTCA
TTCAAAGAATGGGAAAAGGATATGACATATATTTGCCAGTACTTCATCTTCAAGATTTACCCTTTTCCTGTGAAG
TTCAGAGTTACTGAAGATGCTTCTTCCCTTGGGAAGTTGTTGACCCAAGAACATAGGTTATATTTCCCAAATCTT
TAATTATTGAGTGAAAGAGCTATAGATGAATTGATATGGAAAGACCGTATCTTCATTTTCGTGAGTAGAAGGAAA
GATAAGAATGAGGCAGCAGATTTTCCCTCCTGGAATTACACATAAAGGACACTAAGCAATTTTCAAGGTAAATGT
TGCCTTGTTGTTGGTCTTTGGCATGATAAGATTCTTTATTTAAATATGAGAGAATTTTTTTTTATCCTTTATATT
CTCTCAATATCAGAACTCCTGAATTCTGAAGATTGCCCTCCTCCCATTAATAGGATTGTATGGATGTAAGATGGA
ATAAAATACTAGTTCTTCATTTTGAGAAAACTGTACATTAGTTTAATGTTTGTTACTGTATTTCTTTGAGTTGA
GGCACTTACATAACAATCTTCTTTGCTTTTTTGGCAGATAAACCCAACAGAGGTGAGGCCCAGCTAGTAATCCCT
TTTAGTGGGAAAGGATATGTTCTAGGAGAAACAAGCAATTTACCTTCACCTGGGAAACTGATCACTTCACATGCC
ATTAATAAAACCCAAGATCTTTTAAATCAAAACCATTCAGCAAATGCTGTAAGACCTAATTCTAAAATCAAGGTG
AAATTTGAACAGAATGGTTCAAGTAAAAATTCTCATCTGGTCTCCCCTGCTGTTAGTAACAGTCACCAAAATGTT
CTAAGCAACTACTTTCCTAGAGTATCATTTGCCAACCAAAAGGCTTTCAGAGGTGTGAATGGATCTCCAAGGATA
AGTGTAACAGTTGGCAACATCCCTAAAAACTCAGTCTCTTCTAGTTCTCAGAGAAGGGTTTCATCTTCTAAGATA
TCCCTAAGAAATTCTTCAAAAGTAACGGAATCAGCATCTGTGATGCCATCCCAGGATGTGAGTGGGTCTGAAGAT
ACATTCCCAAATAAACGACCTAGGCTAGAAGATAAAAAAAAA
```

FIGURE 78

MDDDLMLALRLQEEWNLQEAERDHAQESLSLVDASWELVDPTPDLQALFVQFNDQFFWGQLEA
VEVKWSVRMTLCAGICSYEGKGGMCSIRLSEPLLKLRPRKDLVETLLHEMIHAYLFVTNNDKD
REGHGPEFCKHMHRINSLTGANITVYHTFHDEVDEYRRHWWRCNGPCQHRPPYYGYVKRATNR
EPSAHDYWWAEHQKTCGGTYIKIKEPENYSKKGKGKAKLGKEPVLAAENKGTFVYILLIFM

Important features of the protein:
Signal peptide:
amino acids 1-41

N-glycosylation sites.
amino acids 148-151, 217-220 cAMP- and cGMP-dependent protein kinase phosphorylation site.
amino acids 184-187

Casein kinase II phosphorylation sites.
amino acids 30-33, 121-124, 154-157, 187-190, 192-195

Tyrosine kinase phosphorylation site.
amino acids 211-218

N-myristoylation sites.
amino acids 59-64, 85-90, 146-151

Neutral zinc metallopeptidases, zinc-binding region signature.
amino acids 108-117

FIGURE 79

```
CGGACGCGTGGGTGGCAACCAGGAGAAGCCAAACTTGGTCCCCCGGCTCGCGGAGTGCCTGCG
AGCGGTGCTCATGGCGCTCTATGAGGTCTTCTCTCACCCGGTCGAGCGCAGTTACCGCGCGGG
GCTCTGCTCCAAAGCCGCGCTGTTCCTGCTGCTGGCCGCTGCGCTCACGTACATCCCGCCGCT
GCTGGTGGCCTTCCGGAGCCACGGGTTTTGGCTGAAGCGGAGCAGCTACGAGGAGCAGCCGAC
CGTGCGCTTCCAACACCAGGTGCTGCTCGTGGCCCTGCTCGGACCCGAAAGCGACGGGTTCCT
CGCCTGGAGCACGTTCCCCGCCTTCAACCGGCTGCAAGGGGATCGCCTGCGCGTCCGCTCGT
TTCGACTAGAGAAGAAGACAGGAACCAGGATGGGAAGACGGACATGTTACATTTTAAGCTGGA
GCTTCCCCTGCAGTCCACGGAGCACGTTCTCGGTGTGCAGCTCATCCTGACTTTCTCCTATCG
ATTACACAGGATGGCGACCCTCGTGATGCAGAGCATGGCGTTTCTCCAGTCCTCCTTTCCTGT
CCCGGGATCCCAGTTATACGTGAACGGAGACCTGAGGCTGCAGCAGAAGCAGCCGCTGAGCTG
TGGTGGCCTAGATGCCCGATACAACATATCCGTGATCAACGGGACCAGCCCCTTTGCCTATGA
CTACGACCTCACCCATATTGTTGCTGCCTACCAGGAGAGGAACGTTACCACCGTCCTGAATGA
TCCCAACCCCATCTGGCTGGTGGGCAGGGCCGCAGATGCTCCATTTGTGATTAATGCTATCAT
CCGATACCCTGTGGAAGTCATTTCTTATCAGCCAGGATTCTGGGAGATGGTAAAGTTCGCCTG
GGTACAGTATGTCAGCATCCTGCTTATCTTCCTCTGGGTGTTTGAAAGAATCAAGATCTTCGT
GTTTCAGAATCAGGTGGTGACCACCATTCCTGTGACAGTGACGCCCCGGGGAGACTTGTGTAA
GGAGCACTTATCCTAGAAAGGCCATTTCTGAAGACTCAGCAGGACCGTGGCTGCCTCATTGTC
ATCTTCTGGGAACATCTTAGGACCTTTTGAAAGAGCCCAGCGGACACCTGCGGGCTTGTGTGC
TTTTCCCTCAGAGACAACGGTTCTTTCCGGTTTTGCTCTACACAGTTCCGTATCTTCAGAGCT
CCTGCAGAATTGTCAGGGACTAGTTTGTGGAAAGGTCTGAGAGTTCCTGGAGGCTATAATTAG
CTTTTTGGGTTTTCCTTCTTTGCCTTAGCGTTGAATTTCAGGAGAAAATTGCAGTCAGTTCAG
ACATCTTGGAAAGAGTCCCATCTCTGGTCAAGCAGAGACTTTTCCTCTGTTGAACTGAGGAAC
ACACTGTGCATTTCTTCCTTCTGTTGTGAGCCACTCTTACTCTTTTCAGGGCTCTCTTGTGAC
AAACATGCCAATCACTAGCACTTTGCACCCTGGGCTTCTCCATTTCCCATTCACAGCTTTGA
TTTCCAGAGCTGAGGCCTTTAACTGGAGACCTGGAGGGGCAGGGCCCAAGGGCAAGGGCCGCA
TTAGCACAGGCAATCAGGGAGGGCCGCTGAAGGACACTTGGACCGTCCACCTGCCCCAGCCCA
ACAGTCAGTCATCTGTCATCAGCTCAGCTGAGCAGCCCTGGATCTTTGCCGTACTGTGACTGG
GCTCTTTGCCCTATTTTTCCCTCTGTCTGTGCCCCTGGATGGCAGGCTGAAGTCAGAGGGGCT
GTTTCATTCTCAGCCCCTCAGCAGCACTGGGGGAAGAAAGCATTGTCACAACAGGTTCTTTC
TGGCCCTCACCCAACAGCCTGGGCACTTGGCCCTCCTCCTCCTTGACAGCCCTCCCCCTTCCT
GCAAAGGACAGGGGCGACAGGGGTTGGTGTTGGGATTGGCTCCCGCTGCCTGACAACCACAAG
TTTATTTGGAAGGCTAGCGGGAAGCCCAGCGGCTGGCGTTTCCCTTGACTAAGGAACAGGGTG
CCCATCAGAGTGGGGCGGGCAGCTTTGGGAAGGACACAAGAAGCAGTAAGAGTGTAAAGAGGA
TGCTGGCCTGGGCAGGCCAGTCCAGCCTGGCCACTAGCAGAATACCAAGCAGTCCAGTGGATT
ACCCTCGTGGCTAAGCAAGTGTCTGCAGGAGCAGAGATGGCTGGAAGGGGCCTCTGCACACGG
AAGATGGCTTGTTCAGCCCATTCACCTCCTGAGGATGTGGGCAGTCTCCTCCAAGAACACATG
GAGCTGCTTCCTGATCCCAAGCAGGTCATTGCCACTGGAAGGACATGGCCCCGGTGATCCATG
CTTCATGCCCACCCAGAAACACACCCCTCAGTGTGTGCCTCAGTTTACTTTGGAGATCAGTTG
TCGTTTTTAGTGCTCCTTTAGGCTTACTAAAACAGTTTTGGAAACAAAGCTATTTTGAAGTAT
TCAAGCAGAGGAATTCCCTAACACTGACCCCCTTGTCTTTTTTAATATTCAGGCTGTTTTAT
ATGCCTAAATTTTTTTCTTAAGATCTAAACGAAAATAGTTTCTTGTTTAAATTCACATAAGG
CAATGAGATATGGAAAGATGACAAGATACGTATAAACATTGGTTTGCATCTTATTAAATTATT
CTAATGCAAATCTTGTATAAAGAACCCATGATGTTTTGTAACTTTCTAATTAAAATGTTCAAA
ATGAG
```

FIGURE 80

MALYEVFSHPVERSYRAGLCSKAALFLLLAAALTYIPPLLVAFRSHGFWLKRSSYEEQPTVRF
QHQVLLVALLGPESDGFLAWSTFPAFNRLQGDRLRVPLVSTREEDRNQDGKTDMLHFKLELPL
QSTEHVLGVQLILTFSYRLHRMATLVMQSMAFLQSSFPVPGSQLYVNGDLRLQQKQPLSCGGL
DARYNISVINGTSPFAYDYDLTHIVAAYQERNVTTVLNDPNPIWLVGRAADAPFVINAIIRYP
VEVISYQPGFWEMVKFAWVQYVSILLIFLWVFERIKIFVFQNQVVTTIPVTVTPRGDLCKEHLS

Important features of the protein:

Signal peptide:

amino acids 1-34

Transmembrane domain:

amino acids 268-284

N-glycosylation sites.

amino acids 194-198, 199-203, 221-225 cAMP- and cGMP-dependent protein kinase phosphorylation site.

amino acids 51-55

Tyrosine kinase phosphorylation site.

amino acids 250-259

N-myristoylation site.

amino acids 187-193

Cell attachment sequence.

amino acids 307-310

FIGURE 81

```
GCCGGGAGCTTCCCTGATGGTGCCGCCGCCTCCGAGCCGGGGAGGAGCTGCCAGGGGCCAGCTGGGCAGGAGCCT
GGGTCCGCTGCTGCTGCTCCTGGCGTTGGGACACACGTGGACCTACAGAGAGGAGCCGGAGGACGGCGACAGAGA
AATCTGCTCAGAGAGCAAAATCGCGACGACTAAATACCCGTGTCTGAAGTCTTCAGGCGAGCTCACCACATGCTA
CAGGAAAAAGTGCTGCAAAGGATATAAATTTGTTCTTGGACAATGCATCCCAGAAGATTACGACGTTTGTGCCGA
GGCTCCCTGTGAACAGCAGTGCACGGACAACTTTGGCCGAGTGCTGTGTACTTGTTATCCGGGATACCGATATGA
CCGGGAGAGACACCGGAAGCGGGAGAAGCCATACTGTCTGGATATTGATGAGTGTGCCAGCAGCAATGGGACGCT
GTGTGCCCACATCTGCATCAATACCTTGGGCAGCTACCGCTGCGAGTGCCGGGAAGGCTACATCCGGGAAGATGA
TGGGAAGACATGTACCAGGGGAGACAAATATCCCAATGACACTGGCCATGAGAAGTCTGAGAACATGGTGAAAGC
CGGAACTTGCTGTGCCACATGCAAGGAGTTCTACCAGATGAAGCAGACCGTGCTGCAGCTGAAGCAAAAGATTGC
TCTGCTCCCCAACAATGCAGCTGACCTGGGCAAGTATATCACTGGTGACAAGGTGCTGGCCTCAAACACCTACCT
TCCAGGACCTCCTGGCCTGCCTGGGGGCCAGGGCCCTCCCGGCTCACCAGGACCAAAGGGAAGCCCAGGCTTCCC
CGGTATGCCAGGCCCTCCTGGGCAGCCCGGCCCACGGGCTCAATGGGACCCATGGGACCATCTCCTGATCTGTC
CCACATTAAGCAAGGCCGGAGGGGCCCTGTGGGTCCACCAGGGGCACCAGGAAGAGATGGTTCTAAGGGGGAGAG
AGGAGCGCCTGGGCCCAGAGGGTCTCCAGGACCCCCTGGTTCTTTCGACTTCCTGCTACTTATGCTGGCTGACAT
CCGCAATGACATCACTGAGCTGCAGGAAAAGGTGTTCGGGCACCGGACTCACTCTTCAGCAGAGGAGTTCCCTTT
ACCTCAGGAATTTCCCAGCTACCCAGAAGCCATGGACCTGGGCTCTGGAGATGACCATCCAAGAAGAACTGAGAC
AAGAGACTTGAGAGCCCCCAGAGACTTCTACCCATAGCACATCCCAACACCGTCACGCCAAAGGAAGAGAAAGAT
CAACTCACCTGCAGTTAAACCATCTAAAGAGAAGAAAGACCACTGGAGACCTAGAAAACATACATTTTTCTCTTC
TCTTCTCCTGACGTCTCTCCACTCCTCTTCTTCCAAATACGATGCTATTTTCAGAGTCCCCTCCTAGGCCTGCAG
ACATGAGGGAGTGAATGATTGATTTACCTGCTTCTCACTAAGAGTCCATTGGGGTGGTTTGCATTGTAACTTTTC
TTTTACATCCTATTTTTCCAGGAACTTTGGATTTAAGTACTCTCACAGTGTCTTAAATCATAAATTCTTGAAGTT
AAATTTGGCAGAGTATCAAAAGGGGGAAAATGACAAAGTGAGCTCTAAGAAAATGTGAGGCTACTTCTAAGATGT
GTGTTCACAATAGACCATAACTCCTCTAGTATCAAAATTGGGGCTCTTCAGTTAAAAAGGGGTGGGGAGGACAAA
CGTGTCGATGTGCTTTGGTGGAGAATTTTTTCCTTGTGCTTCTAGTAGACTTTAAATATTGTATCCCTTTGTCAA
ACCTTGTTTCCCAAATTCAATTAAAGAGAGGAGAGAATTGAATGGCGTTTAGAGAAGATAGAAAAGAATCACAGT
CATATATTTACTGTTATATAGATTGCCACATTCTAAAATTCAAATACGGTGCTTAAGGTTTCATGCCATGCTTAT
CTGTAAGTATCCTATTTAGGGAAGAAGATTAAACTCTCTTTTCAAAAAAACAAAGTGAAATGCCTGGATTCACAT
TAAAACAATGGGCTCTCGTTTGCTATAATATTTTAAAGCTGTTTAATCAACAGTGGAGTCTGCTCTATAAATATA
GATTATTTGTTCAATAAACTGGCTGAGCTTAGAGAGAGGTGCAGAATTCCTGGTTCTGAGCAGGTGCCCAGAAGG
TACCATTAGGTGCCATGATCCAGGCTGAACCAATATACAGTGGGGCTGAAGTCTGCAAGGAGGTTGCTGGCTTGG
GCTGACCTCACTAATGCCATCAGCAGCGGTAGGTAAATTTTTCTCCTTGGGTATTACAAGTTTTGTCTGGAGC
CAACCAAGCTTGCCACCAACATATTGAGAGTAATACACTATTGAAAGTTATCTTGGATGGGGAGAAAAAAAATA
GTGGTTTTCCTTGTTTGCAAAAACTTCCTTCCTATTCTCATTTTTTCTTAATTTTCTTTAATTTAGTCCAAGTTC
CAGTTCTTTTAGGCCTTCTCTTTGATTTATTTTCCCCTGCATGTGAAGCAGTTCAGAAAAAGGTCTATATCTC
CACCTCCTAGTGAGTTAGAGTGTTTTCTCAGAGCACCTCTGGGTGGCAAAGGGAAGCATGTTCCTGCCAAGGTTT
GCTGTGGATTCAGAAGCACCAGGAGCAAGAGACCAGAAGGATGATCTGCTCCTTTGTAACGTTGTTGAGGGCCCT
CTTGTTTCCAATGAGCAGCTTATAGGTTACTCACAGTCCACTTTCTCACTGGACACACAAAGTGGCTCTTTATCT
ACCTTTGCGGGAGATTTTCACTCTCCTGCAAATGATCGTTCTCACACTCATATTAGCTCATGTTGGAATTTCCCA
TCCTGCCATGTCCTTTCCCATTTCTTTTTGGCTTTTTTGCCTCCACCTTTTAGCCCACATCATTTAACTCCACTA
CTGTGAAAGCTTGCTTAAAGAAAATCCCTCTTGGCCGGGTGTGGTAGCCCACGCCTCTAATCCCAGCACTTTGGG
AGGCTGAGGCGGGAGATCACAAGGTCAGGAGATCGAGACCAGCCTGACCAACATGGTGAAACCCTGTCTCTACT
AAAAATACAAAAATTAGCTGGGCGTGTTGGCACACACCTGTAATCCCAGCTACTCAGGAGGCTGAGGCAGGAGAA
TTACTTTAACCTGCGGGGGGAGCCTAGATTGCGCTACTGCACTCCAGCCTAGGCAACAGAGGGAGACTCTGTCTC
ATTAAAAA
```

FIGURE 82

MVPPPPSRGGAARGQLGRSLGPLLLLLALGHTWTYREEPEDGDREICSESKIATTKYPCLKSS
GELTTCYRKKCCKGYKFVLGQCIPEDYDVCAEAPCEQQCTDNFGRVLCTCYPGYRYDRERHRK
REKPYCLDIDECASSNGTLCAHICINTLGSYRCECREGYIREDDGKTCTRGDKYPNDTGHEKS
ENMVKAGTCCATCKEFYQMKQTVLQLKQKIALLPNNAADLGKYITGDKVLASNTYLPGPPGLP
GGQGPPGSPGPKGSPGFPGMPGPPGQPGPRGSMGPMGPSPDLSHIKQGRRGPVGPPGAPGRDG
SKGERGAPGPRGSPGPPGSFDFLLLMLADIRNDITELQEKVFGHRTHSSAEEFPLPQEFPSYP
EAMDLGSGDDHPRRTETRDLRAPRDFYP

Important features of the protein:
Signal peptide:
amino acids 1-34
N-glycosylation sites.
amino acids 142-148, 182-188
Tyrosine kinase phosphorylation site.
amino acids 125-132
N-myristoylation sites.
amino acids 10-16, 143-149, 155-161, 196-202, 250-256
Amidation site.
amino acids 299-303
Aspartic acid and asparagine hydroxylation site.
amino acids 150-162
Cell attachment sequence.
amino acids 176-179
C1q domain proteins.
amino acids 247-280
Calcium-binding EGF-like domain proteins pattern proteins.
amino acids 144-165

FIGURE 83

ATCTGAGTGAGCTAACTGACACAA<u>ATG</u>AAACTGTCAGGCATGTTTCTGCTCCTCTCTCTGGCTC
TTTTCTGCTTTTTAACAGGTGTCTTCAGTCAGGGAGGACAGGTTGACTGTGGTGAGTTCCAGG
ACCCCAAGGTCTACTGCACTCGGGAATCTAACCCACACTGTGGCTCTGATGGCCAGACATATG
GCAATAAATGTGCCTTCTGTAAGGCCATAGTGAAAAGTGGTGGAAAGATTAGCCTAAAGCATC
CTGGAAAATGC<u>TGA</u>GTTAAAGCCAATGTTTCTTGGTGACTTGCCAGCTTTTGCAGCCTTCTTT
TCTCACTTCTGCTTATACTTTTGCTGGTGGATTCCTTTAATTCATAAAGACATACCTACTCTG
CCTGGGTCTTGAGGAGTTCAATGTATGTCTATTTCTCTTGATTCACTTGTCAATAAAGTACATTC
TGCAAAAGCAAAAA

FIGURE 84

MKLSGMFLLLSLALFCFLTGVFSQGGQVDCGEFQDPKVYCTRESNPHCGSDGQTYGNKCAFCK
AIVKSGGKISLKHPGKC

Important features of the protein:

Signal peptide:

amino acids 1-23

N-myristoylation sites.

amino acids 26-32, 52-58, 56-62, 69-75

Kazal serine protease inhibitors family signature.

amino acids 40-63

FIGURE 85

```
GGAGCAGACACACAGACCCGGGCCGGAGGCCCCTCTTCTAGCCCTGCGGGAACCGGACAGTTC
CCCAACTGGGGACTCTGGAACCACAGCTCCTAAATCATCAAATTCTCAAGCTTTTTTTTCCC
TCTCTTCGTCCCAGCCATCCCAGTCTTCTTCTTCTTTTTTTTTTTTTAACTTATTGTTTTTT
TCGCTCCTGTCATTATGAAAGTGGTCACGCCATTCAATATTAAGACTTGGAGGGAATTGGGGA
AAGAAAAGAAAGAATCTAAAAGAAGAGAAGCGACCGGTGCTTTTAAGGGTGTCTAATTTTCAA
AAGAGACGTCTGGGAGTATTTTGCTCTGGGCGTTTGGAGCAACTTCGCGGACAGCGGAGCTCG
CCCAGCATGGATGTTCCAGGTTCACAGGCGCCTTTCTTCTGAGAACGACCCTGGCCTTGAACG
TCAGAGCCGGGGACGAAGGCCCCGGAGGCTGCTGCGAGCTCCGCGCGTTCCTTCGCGCCCTT
CCGCGCCGCTCGCGCCGGCGCCGGCCTCCACCCCGCGCGCCGCCTCCCACCAGTCCCGATGC
AGGCGCCCGGCCGGGGCCACTCGGGCTGCGGCTGATGATGCCCGGGCGCCGGGGGCGCTGC
GCGAGCCTGGCGGCTGCGGATCCTGCCTGGGGGTGGCGCTGGCCCTGCTGTTGCTGCTACTGC
CCGCCTGCTGCCCCGTGCGGGCGCAGAACGACACGGAGCCCATCGTGCTGGAGGGCAAGTGCC
TGGTGGTGTGCGACTCCAGCCCGTCGGCGGACGGCGCCGTCACCTCCTCCCTAGGCATCTCCG
TGCGCTCCGGCAGCGCCAAGGTGGCCTTCTCCGCCACGCGGAGCACCAACCACGAGCCGTCCG
AGATGAGCAACCGCACCATGACCATCTATTTCGACCAGGTATTAGTAAATATTGGCAACCACT
TTGATCTTGCTTCCAGTATATTTGTAGCACCGAGAAAGGGATTTATAGCTTCAGCTTCCACG
TGGTCAAAGTGTATAACAGACAAACCATCCAGGTCAGTTTAATGCAGAATGGCTACCCAGTGA
TCTCGGCCTTTGCAGGAGACCAGGATGTCACCAGAGAAGCTGCTAGCAATGGCGTGCTGCTGC
TCATGGAAAGGGAAGACAAAGTGCATCTCAAACTTGAGAGAGGCAACCTCATGGGGGCTGGA
AATACTCCACATTCTCGGGCTTCTTGGTGTTTCCTCTATAAACACAGAGCCCCCTAGATGGTG
GGGGAATGGCAAACTGGACCCAGGACTCCGCCCTTTAAAACACCCTGAACTTACTGGAATTGG
ACACCTTGTTTCCAACCTCCGTCAGACTGTTGCAGTAGAAGAATGATTTCCTTTGAAACCTCC
AGTACTTTTGTTTTTGTTTTTTGGAATACTGACAATTCCTCGGGAACCTGGCCTCTAATTAGT
TTTAGATGACAAGGTCTTAAGGAGAAATGAAATTATCGATTTGAGCAATTTGTACCTGTGATT
GTAAAGTCAATATCGGATTTTATTGTTGGGACCATGGACCTCTTTTGTTTGTATGTTGTATTG
TCGTCCCAACGGAAGGAGAGCTCCTGACTCCAGGATGGGCTGCAGGTTGCAGTCAGGGCTTGA
AGTAGGAGCCCAGCAAAGAACCACCTGCTGGACAGTCCTTGACATGTGTTCTGTGTGTGTCTG
TATAGCCTTAAGAAAAGAATGGCTTCACTTTCATTCTGTATTCTTCCCCCCACCATGTGGCT
GGGAGGACTTGGGAGGGGATGGGGACATTGGGAACCTGTCAAGAAGTGCTTTATCCAGAGAA
GCAAATTTTGCACGATTGGACTGCAATTTTTGTTTTGTATTGTTTGTGTTTTTCTTGAAAAG
CTTTACTTTTCTTTCCACACTCAGCTCTCCCTCCTCAACCCCACTTTTATTTTTCTTGCTGGG
GTTGAGGAGAGAAAATATAGAATTCCTGGATAAGACCAAACAAAACAAAACATTAAAATACCT
GTATGTTTTGTTTTAGACGAGACCAAACTAAACAAAAAGTATCTGTTTATCAAAGTAAAAGTA
ACACAATGGACAATTCTGCTTATTCTCTCAAAGAGATTCTAAGATGCACCTTTAGAACTATTA
ATAGCAACCTGCATTTTTTTTAATTTATACTTCAGAATCCTTTAAGAACCTGGTGTTCCTGA
GTGGTCCTGAATCATATAAGTTGGTAATGGAAGCTGTAATGACCAAGTCCCCTAAACATACTA
TGTCTTTGCCACGTGTGCTGTGACTTCTCTGTGGGTGATTTAATTTATTTGGATCCACCTCTG
AGTGAGCGCACAGTGATCAGGTGCTTCAAAGCCAACAGACCAGCTCCTCTTCCTCCGGATCCT
CTTTTGATCTGCCCAGGAAAGGGATGCATTGACACTCTCCTGCATGCACCTGGCGAGAAGCCA
CCTGAAAGTCACTGTGGTTAAAGATATTGGTGGAGGTACCCCAGGAGCACTGTTACAAATCCT
TCTTGTTTTGGCATCTCGTACAACATTATTAAGACACAGCTGAGAGTTGATGGGTGTGTAATG
CATATGCCAAGGAAATGTCACTAATCCCAAAGCAATCAAAAAGGAGACCTCAAACCAGATGTT
AATTTGTTCTTTGTGTAACAATGTAACCAAAATATTGATGATAAAAGTCATAATTTAAGATTC
AGAATAAATGGGTTTGATGTCTGGCAAAAAAAAAAAAAAAAA
```

FIGURE 86

MQAPGRGPLGLRLMMPGRRGALREPGGCGSCLGVALALLLLLLPACCPVRAQNDTEPIVLEGK
CLVVCDSSPSADGAVTSSLGISVRSGSAKVAFSATRSTNHEPSEMSNRTMTIYFDQVLVNIGN
HFDLASSIFVAPRKGIYSFSFHVVKVYNRQTIQVSLMQNGYPVISAFAGDQDVTREAASNGVL
LLMEREDKVHLKLERGNLMGGWKYSTFSGFLVFPL

Important features of the protein:

Signal peptide:

amino acids 1-48

N-glycosylation sites.

amino acids 53-57, 110-114

N-myristoylation sites.

amino acids 26-32, 27-33, 29-35, 33-39, 76-82, 205-211

Amidation site.

amino acids 16-20

C1q domain signature.

amino acids 117-148

C1q domain proteins.

amino acids 115-149

FIGURE 87

```
AGGGCCCGCGGGTGGAGAGAGCGACGCCCGAGGGGATGGCGGCAGCGTCCCGGAGCGCCTCTG
GCTGGGCGCTACTGCTGCTGGTGGCACTTTGGCAGCAGCGCGCGGCCGGCTCCGGCGTCTTCC
AGCTGCAGCTGCAGGAGTTCATCAACGAGCGCGGCGTACTGGCCAGTGGGCGGCCTTGCGAGC
CCGGCTGCCGGACTTTCTTCCGCGTCTGCCTTAAGCACTTCCAGGCGGTCGTCTCGCCCGGAC
CCTGCACCTTCGGGACCGTCTCCACGCCGGTATTGGGCACCAACTCCTTCGCTGTCCGGGACG
ACAGTAGCGGCGGGGGCGCAACCCTCTCCAACTGCCCTTCAATTTCACCTGGCCGGGTACCT
TCTCGCTCATCATCGAAGCTTGGCACGCGCCAGGAGACGACCTGCGGCCAGAGGCCTTGCCAC
CAGATGCACTCATCAGCAAGATCGCCATCCAGGGCTCCCTAGCTGTGGGTCAGAACTGGTTAT
TGGATGAGCAAACCAGCACCCTCACAAGGCTGCGCTACTCTTACCGGGTCATCTGCAGTGACA
ACTACTATGGAGACAACTGCTCCCGCCTGTGCAAGAAGCGCAATGACCACTTCGGCCACTATG
TGTGCCAGCCAGATGGCAACTTGTCCTGCCTGCCCGGTTGGACTGGGGAATATTGCCAACAGC
CTATCTGTCTTTCGGGCTGTCATGAACAGAATGGCTACTGCAGCAAGCCAGCAGAGTGCCTCT
GCCGCCCAGGCTGGCAGGGCCGGCTGTGTAACGAATGCATCCCCCACAATGGCTGTCGCCACG
GCACCTGCAGCACTCCCTGGCAATGTACTTGTGATGAGGGCTGGGGAGGCCTGTTTTGTGACC
AAGATCTCAACTACTGCACCCACCACTCCCCATGCAAGAATGGGGCAACGTGCTCCAACAGTG
GGCAGCGAAGCTACACCTGCACCTGTCGCCCAGGCTACACTGGTGTGGACTGTGAGCTGGAGC
TCAGCGAGTGTGACAGCAACCCCTGTCGCAATGGAGGCAGCTGTAAGGACCAGGAGGATGGCT
ACCACTGCCTGTGTCCTCCGGGCTACTATGGCCTGCACTGTGAACACAGCACCTTGAGCTGCG
CCGACTCCCCCTGCTTCAATGGGGGCTCCTGCCGGGAGCGCAACCAGGGGCCAACTATGCTT
GTGAATGTCCCCCCAACTTCACCGGCTCCAACTGCGAGAAGAAAGTGGACAGGTGCACCAGCA
ACCCCTGTGCCAACGGGGGACAGTGCCTGAACCGAGGTCCAAGCCGCATGTGCCGCTGCCGTC
CTGGATTCACGGGCACCTACTGTGAACTCCACGTCAGCGACTGTGCCCGTAACCCTTGCGCCC
ACGGTGGCACTTGCCATGACCTGGAGAATGGGCTCATGTGCACCTGCCCTGCCGGCTTCTCTG
GCCGACGCTGTGAGGTGCGGACATCCATCGATGCCTGTGCCTCGAGTCCCTGCTTCAACAGGG
CCACCTGCTACACCGACCTCTCCACAGACACCTTTGTGTGCAACTGCCCTTATGGCTTTGTGG
GCAGCCGCTGCGAGTTCCCCGTGGGCTTGCCGCCCAGCTTCCCCTGGGTGGCCGTCTCGCTGG
GTGTGGGGCTGGCAGTGCTGCTGGTACTGCTGGGCATGGTGGCAGTGGCTGTGCGGCAGCTGC
GGCTTCGACGGCCGGACGACGGCAGCAGGGAAGCCATGAACAACTTGTCGGACTTCCAGAAGG
ACAACCTGATTCCTGCCGCCCAGCTTAAAAACACAAACCAGAAGAAGGAGCTGGAAGTGGACT
GTGGCCTGGACAAGTCCAACTGTGGCAAACAGCAAAACCACACATTGGACTATAATCTGGCCC
CAGGGCCCCTGGGCGGGGGACCATGCCAGGAAAGTTTCCCCACAGTGACAAGAGCTTAGGAG
AGAAGGCGCCACTGCGGTTACACAGTGAAAAGCCAGAGTGTCGGATATCAGCGATATGCTCCC
CCAGGGACTCCATGTACCAGTCTGTGTGTTTGATATCAGAGGAGAGGAATGAATGTGTCATTG
CCACGGAGGTATAAGGCAGGAGCCTACCTGGACATCCCTGCTCAGCCCCGCGGCTGGACCTTC
CTTCTGCATTGTTTACA
```

FIGURE 88

MAAASRSASGWALLLLVALWQQRAAGSGVFQLQLQEFINERGVLASGRPCEPGCRTFFRVCLK
HFQAVVSPGPCTFGTVSTPVLGTNSFAVRDDSSGGGRNPLQLPFNFTWPGTFSLIIEAWHAPG
DDLRPEALPPDALISKIAIQGSLAVGQNWLLDEQTSTLTRLRYSYRVICSDNYYGDNCSRLCK
KRNDHFGHYVCQPDGNLSCLPGWTGEYCQQPICLSGCHEQNGYCSKPAECLCRPGWQGRLCNE
CIPHNGCRHGTCSTPWQCTCDEGWGGLFCDQDLNYCTHHSPCKNGATCSNSGQRSYTCTCRPG
YTGVDCELELSECDSNPCRNGGSCKDQEDGYHCLCPPGYYGLHCEHSTLSCADSPCFNGGSCR
ERNQGANYACECPPNFTGSNCEKKVDRCTSNPCANGGQCLNRGPSRMCRCRPGFTGTYCELHV
SDCARNPCAHGGTCHDLENGLMCTCPAGFSGRRCEVRTSIDACASSPCFNRATCYTDLSTDTF
VCNCPYGFVGSRCEFPVGLPPSFPWVAVSLGVGLAVLLVLLGMVAVAVRQLRLRRPDDGSREA
MNNLSDFQKDNLIPAAQLKNTNQKKELEVDCGLDKSNCGKQQNHTLDYNLAPGPLGRGTMPGK
FPHSDKSLGEKAPLRLHSEKPECRISAICSPRDSMYQSVCLISEERNECVIATEV

Important features of the protein:

Signal peptide:

amino acids 1-26

Transmembrane domain:

amino acids 530-552

N-glycosylation sites.

amino acids 108-112, 183-187, 205-209, 393-397, 570-574, 610-614

Glycosaminoglycan attachment site.

amino acids 96-100

Tyrosine kinase phosphorylation site.

amino acids 340-347

N-myristoylation sites.

amino acids 42-48, 204-210, 258-264, 277-283, 297-303, 383-389, 415-421, 461-467, 522-528, 535-541, 563-569, 599-605, 625-631

Amidation site.

amino acids 471-475

Aspartic acid and asparagine hydroxylation site.

amino acids 339-351

EGF-like domain cysteine pattern signature.

amino acids 173-185, 206-218, 239-251, 270-282, 310-322, 348-360, 388-400, 426-438, 464-476, 506-518

Calcium-binding EGF-like:

amino acids 224-245, 255-276, 295-316, 333-354, 373-394, 411-432, 449-470

FIGURE 89

```
GTCTCCGCGTCACAGGAACTTCAGCACCCACAGGGCGGACAGCGCTCCCCTCTACCTGGAGAC
TTGACTCCCGCGCGCCCCAACCCTGCTTATCCCTTGACCGTCGAGTGTCAGAGATCCTGCAGC
CGCCCAGTCCCGGCCCCTCTCCCGCCCCACACCCACCCTCCTGGCTCTTCCTGTTTTTACTCC
TCCTTTTCATTCATAACAAAAGCTACAGCTCCAGGAGCCCAGCGCCGGGCTGTGACCCAAGCC
GAGCGTGGAAGAATGGGGTTCCTCGGGACCGGCACTTGGATTCTGGTGTTAGTGCTCCCGATT
CAAGCTTTCCCCAAACCTGGAGGAAGCCAAGACAAATCTCTACATAATAGAGAATTAAGTGCA
GAAAGACCTTTGAATGAACAGATTGCTGAAGCAGAAGAAGACAAGATTAAAAAAACATATCCT
CCAGAAAACAAGCCAGGTCAGAGCAACTATTCTTTTGTTGATAACTTGAACCTGCTAAAGGCA
ATAACAGAAAAGGAAAAATTGAGAAAGAAAGACAATCTATAAGAAGCTCCCACTTGATAAT
AAGTTGAATGTGGAAGATGTTGATTCAACCAAGAATCGAAAACTGATCGATGATTATGACTCT
ACTAAGAGTGGATTGGATCATAAATTTCAAGATGATCCAGATGGTCTTCATCAACTAGACGGG
ACTCCTTTAACCGCTGAAGACATTGTCCATAAAATCGCTGCCAGGATTTATGAAGAAATGAC
AGAGCCGTGTTTGACAAGATTGTTTCTAAACTACTTAATCTCGGCCTTATCACAGAAAGCCAA
GCACATACACTGGAAGATGAAGTAGCAGAGGTTTTACAAAAATTAATCTCAAAGGAAGCCAAC
AATTATGAGGAGGATCCCAATAAGCCCACAAGCTGGACTGAGAATCAGGCTGGAAAAATACCA
GAGAAAGTGACTCCAATGGCAGCAATTCAAGATGGTCTTGCTAAGGGAGAAAACGATGAAACA
GTATCTAACACATTAACCTTGACAAATGGCTTGGAAAGGAGAACTAAAACCTACAGTGAAGAC
AACTTTGAGGAACTCCAATATTTCCCAAATTTCTATGCGCTACTGAAAAGTATTGATTCAGAA
AAAGAAGCAAAAGAGAAAGAAACACTGATTACTATCATGAAAACACTGATTGACTTTGTGAAG
ATGATGGTGAAATATGGAACAATATCTCCAGAAGAAGGTGTTTCCTACCTTGAAAACTTGGAT
GAAATGATTGCTCTTCAGACCAAAAACAAGCTAGAAAAAAATGCTACTGACAATATAAGCAAG
CTTTTCCCAGCACCATCAGAGAAGAGTCATGAAGAAACAGACAGTACCAAGGAAGAAGCAGCT
AAGATGGAAAAGGAATATGGAAGCTTGAAGGATTCCACAAAAGATGATAACTCCAACCCAGGA
GGAAAGACAGATGAACCCAAAGGAAAAACAGAAGCCTATTTGGAAGCCATCAGAAAAAATATT
GAATGGTTGAAGAAACATGACAAAAAGGGAAATAAAGAAGATTATGACCTTTCAAAGATGAGA
GACTTCATCAATAAACAAGCTGATGCTTATGTGGAGAAAGGCATCCTTGACAAGGAAGAAGCC
GAGGCCATCAAGCGCATTTATAGCAGCCTGTAAAAATGGCAAAGATCCAGGAGTCTTTCAAC
TGTTTCAGAAAACATAATATAGCTTAAAACACTTCTAATTCTGTGATTAAAATTTTTTGACCC
AAGGGTTATTAGAAAGTGCTGAATTTACAGTAGTTAACCTTTTACAAGTGGTTAAAACATAGC
TTTCTTCCCGTAAAAACTATCTGAAAGTAAAGTTGTATGTAAGCTGAAAAAAAAAAAAAAAA
AAA
```

FIGURE 90

MGFLGTGTWILVLVLPIQAFPKPGGSQDKSLHNRELSAERPLNEQIAEAEEDKIKKTYPPENK
PGQSNYSFVDNLNLLKAITEKEKIEKERQSIRSSPLDNKLNVEDVDSTKNRKLIDDYDSTKSG
LDHKFQDDPDGLHQLDGTPLTAEDIVHKIAARIYEENDRAVFDKIVSKLLNLGLITESQAHTL
EDEVAEVLQKLISKEANNYEEDPNKPTSWTENQAGKIPEKVTPMAAIQDGLAKGENDETVSNT
LTLTNGLERRTKTYSEDNFEELQYFPNFYALLKSIDSEKEAKEKETLiTIMKTLIDFVKMMVK
YGTISPEEGVSYLENLDEMIALQTKNKLEKNATDNISKLFPAPSEKSHEETDSTKEEAAKMEK
EYGSLKDSTKDDNSNPGGKTDEPKGKTEAYLEAIRKNIEWLKKHDKKGNKEDYDLSKMRDFIN
KQADAYVEKGILDKEEAEAIKRIYSSL

Important features:
N-glycosylation sites:
amino acids 68-71, 346-349, 350-353

Casein kinase II phosphorylation site:
amino acids 70-73, 82-85, 97-100, 125-128, 147-150, 188-191, 217-220, 265-268, 289-292, 305-308, 320-323, 326-329, 362-365, 368-341, 369-372, 382-385, 386-389, 387-390

N-myristoylation sites:
amino acids 143-148, 239-244

FIGURE 91

TGCATCAGTGCCCAGGCAAGCCCAGGAGTTGACATTTCTCTGCCCAGCCATGGGCCTCACCCT
GCTCTTGCTGCTGCTCCTGGGACTAGAAGGTCAGGGCATAGTTGGCAGCCTCCCTGAGGTGCT
GCAGGCACCCGTGGGAAGCTCCATTCTGGTGCAGTGCCACTACAGGCTCCAGGATGTCAAAGC
TCAGAAGGTGTGGTGCCGGTTCTTGCCGGAGGGGTGCCAGCCCCTGGTGTCCTCAGCTGTGGA
TCGCAGAGCTCCAGCGGGCAGGCGTACGTTTCTCACAGACCTGGGTGGGGCCTGCTGCAGGT
GGAAATGGTTACCCTGCAGGAAGAGGATGCTGGCGAGTATGGCTGCATGGTGGATGGGGCCAG
GGGGCCCCAGATTTTGCACAGAGTCTCTCTGAACATACTGCCCCCAGAGGAAGAAGAAGAGAC
CCATAAGATTGGCAGTCTGGCTGAGAACGCATTCTCAGACCCTGCAGGCAGTGCCAACCCTTT
GGAACCCAGCCAGGATGAGAAGAGCATCCCCTTGATCTGGGGTGCTGTGCTCCTGGTAGGTCT
GCTGGTGGCAGCGGTGGTGCTGTTTGCTGTGATGGCCAAGAGGAAACAAGAATCCCTCCTCAG
TGGTCCACCACGTCAGTGACTCTGGACCGGCTGCTGAATTGCCTTTGGATGTACCACACATTA
GGCTTGACTCACCACCTTCATTTGACAATACCACCTACACCAGCCTACCTCTTGATTCCCCAT
CAGGAAAACCTTCACTCCCAGCTCCATCCTCATTGCCCCCTCTACCTCCTAAGGTCCTGGTCT
GCTCCAAGCCTGTGACATATGCCACAGTAATCTTCCCGGGAGGGAACAAGGGTGGAGGGACCT
CGTGTGGGCCAGCCCAGAATCCACCTAACAATCAGACTCCATCCAGCTAAGCTGCTCATCACA
CTTTAAACTCATGAGGACCATCCCTAGGGGTTCTGTGCATCCATCCAGCCAGCTCATGCCCTA
GGATCCTTAGGATATCTGAGCAACCAGGGACTTTAAGATCTAATCCAATGTCCTAACTTTACT
AGGGAAAGTGACGCTCAGACATGACTGAGATGTCTTGGGGAAGACCTCCCTGCACCCAACTCC
CCCACTGGTTCTTCTACCATTACACACTGGGCTAAATAAACCCTAATAATGATGTGCAAAAAA
AAAAAAAAAAAAAAAAAAAAAAAAAAAAAAAAAAAAAAAA

FIGURE 92

MGLTLLLLLLLGLEGQGIVGSLPEVLQAPVGSSILVQCHYRLQDVKAQKVWCRFLPEGCQPLV
SSAVDRRAPAGRRTFLTDLGGGLLQVEMVTLQEEDAGEYGCMVDGARGPQILHRVSLNILPPE
EEEETHKIGSLAENAFSDPAGSANPLEPSQDEKSIPLIWGAVLLVGLLVAAVVLFAVMAKRKQ
ESLLSGPPRQ

Important features of the protein:

Signal peptide:

amino acids 1-15

Transmembrane domain:

amino acids 161-181

N-myristoylation sites.

amino acids 17-23, 172-178

Amidation site.

amino acids 73-79

FIGURE 93

```
GGCGGCGTTGCCGGGCTCTCCGGAAGGAGACGTGGCGGCGGTTGGGCCGGTGATACCCGGGCG
CTTTATAGTCCCGCCGCCTCCTCCTCCACCTCCTCCTCCTCCTCCTCTCCTCCTGGGGCAGAG
GAGGTTGTGGCGGTGGCTGGAGAAAGCGGCGGCGGAGGATGGAGGAAGGAGGCGGCGGCGTAC
GGAGTCTGGTCCCGGGCGGGCCGGTGTTACTGGTCCTCTGCGGCCTCCTGGAGGCGTCCGGCG
GCGGCCGAGCCCTTCCTCAACTCAGCGATGACATCCCTTTCCGAGTCAACTGGCCCGGCACCG
AGTTCTCTCTGCCCACAACTGGAGTTTTATATAAAGAAGATAATTATGTCATCATGACAACTG
CACATAAAGAAAATATAAATGCATACTTCCCCTTGTGACAAGTGGGGATGAGGAAGAAGAAA
AGGATTATAAAGGCCCTAATCCAAGAGAGCTTTTGGAGCCACTATTTAAACAAAGCAGTTGTT
CCTACAGAATTGAGTCTTATTGGACTTACGAAGTATGTCATGGAAAACACATTCGGCAGTACC
ATGAAGAGAAAGAAACTGGTCAGAAAATAAATATTCACGAGTACTACCTTGGGAATATGTTGG
CCAAGAACCTTCTATTTGAAAAAGAACGAGAAGCAGAAGAAAAGGAAAAATCAAATGAGATTC
CCACTAAAAATATCGAAGGTCAGATGACACCATACTATCCTGTGGGAATGGGAAATGGTACAC
CTTGTAGTTTGAAACAGAACCGGCCCAGATCAAGTACTGTGATGTACATATGTCATCCTGAAT
CTAAGCATGAAATTCTTTCAGTAGCTGAAGTTACAACTTGTGAATATGAAGTTGTCATTTGA
CACCACTCTTGTGCAGTCATCCTAAATATAGGTTCAGAGCATCTCCTGTGAATGACATATTTT
GTCAATCACTGCCAGGATCTCCATTTAAGCCCCTCACCCTGAGGCAGCTGGAGCAGCAGGAAG
AAATACTAAGGGTGCCTTTTAGGAGAAATAAAGAGGGTGTCGGTTGGTGGAAATATGAATTCT
GCTATGGCAAACATGTACATCAATACCATGAGGACAAGGATAGTGGGAAAACCTCTGTGGTTG
TCGGGACATGGAACCAAGAAGAGCATATTGAATGGGCTAAGAAGAATACTGCTAGAGCTTATC
ATCTTCAAGACGATGGTACCCAGACAGTCAGGATGGTGTCACATTTTTATGGAAATGGAGATA
TTTGTGATATAACTGACAAACCAAGACAGGTGACTGTAAAACTAAAGTGCAAAGAATCAGATT
CACCTCATGCTGTTACTGTATATATGCTAGAGCCTCACTCCTGTCAATATATTCTTGGGGTTG
AATCTCCAGTGATCTGTAAAATCTTAGATACAGCAGATGAAAATGGACTTCTTTCTCTCCCCA
ACTAAAGGATATTAAAGTTAGGGGAAAGAAAAGATCATTGAAAGTCATGATAATTTCTGTCCC
ACTGTGTCTCATTATAGAGTTCTCAGCCATTGGACCTCTTCTAAAGGATGGTATAAAATGACT
CTCAACCACTTTGTGAATACATATGTGTATATAAGAGGTTATTGATAAACTTCTGAGGCAGAC
ATTTGTCTCGCTTTTTTTCATTTTTGTTGTGTCTTATAAACTGACTGTTTTTCTTTGCTTGGA
TACTGTGATTCCAAAATAAATCTCATCCAAGCAAGTTAGAGTCCAGCCTAATCAAATGTCATA
ATTGTTGTACCTATTGAAAGTTTTTAAATAATAGATTTATTATGTAAATTATAGTATATGTAA
GTAGCTAATGAAGTAAAGATCATGAAGAAAGAAATTGATAGGTGTAAATGAGAGACCATGTAA
AATATGTAAATTCTAGTACCTGAAATCCTTTCAACAGATTTTTATATAGCAACTGCTCTCTGC
AAGTAGTTAAACTAGAAACTGGGCACATGGTAGAGGCTCACATGGGAGTTGTCCTCACCCTTG
TTAATCTCAAGAAACTCTTATTTATAATAGGTTGCTTCTCTCTCAGAACTTTTATCTATTACT
TTTTTCTTCTTATGAGTATGTTTACTCTCAGAGTATCTATCTGATGTAGACAGTTGGTGATGC
TTCTGAGACTCAGAATGGTTTACTCTAACAAAACACTGTGCTGTCTATCCCTTGTACTTGCCT
ACTGTAATATGGATTTCACTTCTGAACAGTTTACAGCACAATATTTATTTTAAAGTGAATAAA
ATGTCCACAAGCAAAAA
```

FIGURE 94

MEEGGGGVRSLVPGGPVLLVLCGLLEASGGGRALPQLSDDIPFRVNWPGTEFSLPTTGVLYKE
DNYVIMTTAHKEKYKCILPLVTSGDEEEEKDYKGPNPRELLEPLFKQSSCSYRIESYWTYEVC
HGKHIRQYHEEKETGQKINIHEYYLGNMLAKNLLFEKEREAEEKEKSNEIPTKNIEGQMTPYY
PVGMGNGTPCSLKQNRPRSSTVMYICHPESKHEILSVAEVTTCEYEVVILTPLLCSHPKYRFR
ASPVNDIFCQSLPGSPFKPLTLRQLEQQEEILRVPFRRNKEGVGWWKYEFCYGKHVHQYHEDK
DSGKTSVVVGTWNQEEHIEWAKKNTARAYHLQDDGTQTVRMVSHFYGNGDICDITDKPRQVTV
KLKCKESDSPHAVTVYMLEPHSCQYILGVESPVICKILDTADENGLLSLPN

Important features of the protein:

Signal peptide:
amino acids 1-30

Glycosaminoglycan attachment site.
amino acids 28-32 cAMP- and cGMP-dependent protein kinase phosphorylation site.
amino acids 337-341

N-myristoylation sites.
amino acids 6-12, 23-29, 29-35, 49-55, 141-147, 152-158, 192-198, 196-202

Gram-positive cocci surface proteins 'anchoring' hexapeptide.
amino acids 54-60

FIGURE 95

```
TTCCGTTTCTGGGAGGAGTGAGGGGCAACGGGTCGGAGAAAAAGGAAAAAGAAGGGCTCAGC
GCCTCCCCGCCGGGCCGTGGACAGAGGGGCACAGTTTCGGCAGGCGGGTGAGGTCGCTGAGGG
CCCGCCGGAGATGTTTTCCTTGTCGAGCACGGTGCAACCCCAGGTTACAGTTCCTCTGAGTCA
TCTCATCAATGCCTTCCATACACCAAAAAACACTTCTGTTTCTCTCAGTGGAGTGTCAGTTTC
TCAAAACCAGCATCGAGATGTAGTTCCTGAGCATGAGGCTCCCAGCAGTGAGCCTTCACTTAA
CTTAAGGGACCTTGGATTATCTGAACTAAAAATTGGACAGATTGATCAGCTGGTAGAAAATCT
ACTTCCTGGATTTTGTAAAGGCAAAAACATTTCTTCCCATTGGCATACATCCCATGTCTCTGC
ACAATCCTTCTTTGAAAATAAATATGGTAACTTAGATATATTTAGTACATTACGTTCCTCTTG
CTTGTATCGACATCATTCAAGAGCTCTTCAAAGCATTTGTTCAGATCTTCAGTACTGGCCAGT
TTTCATACAGTCTCGGGTTTTAAAACTTTGAAATCAAGGACACGACGTCTCCAGTCTACCTC
CGAGAGATTAGCTGAAACACAGAATATAGCGCCATCATTCGTGAAGGGGTTTCTTTTGCGGGA
CAGAGGATCAGATGTTGAGAGTTTGGACAAACTCATGAAAACCAAAAATATACCTGAAGCTCA
CCAAGATGCATTTAAAACTGGTTTTGCGGAAGGTTTTCTGAAAGCTCAAGCACTCACACAAA
AACCAATGATTCCCTAAGGCGAACCCGTCTGATTCTCTTCGTTCTGCTGCTATTCGGCATTTA
TGGACTTCTAAAAAACCCATTTTATCTGTCCGCTTCCGGACAACAACAGGGCTTGATTCTGC
AGTAGATCCTGTCCAGATGAAAAATGTCACCTTTGAACATGTTAAAGGGGTGGAGGAAGCTAA
ACAAGAATTACAGGAAGTTGTTGAATTCTTGAAAAATCCACAAAAATTTACTATTCTTGGAGG
TAAACTTCCAAAAGGAATTCTTTTAGTTGGACCCCAGGGACTGGAAAGACACTTCTTGCCCG
AGCTGTGGCGGGAGAAGCTGATGTTCCTTTTTATTATGCTTCTGGATCCGAATTTGATGAGAT
GTTTGTGGGTGTGGGAGCCAGCCGTATCAGAAATCTTTTTAGGGAAGCAAAGGCGAATGCTCC
TTGTGTTATATTTATTGATGAATTAGATTCTGTTGGTGGGAAGAGAATTGAATCTCCAATGCA
TCCATATTCAAGGCAGACCATAAATCAACTTCTTGCTGAAATGGATGGTTTTAAACCCAATGA
AGGAGTTATCATAATAGGAGCCACAAACTTCCCAGAGGCATTAGATAATGCCTTAATACGTCC
TGGTCGTTTTGACATGCAAGTTACAGTTCCAAGGCCAGATGTAAAAGGTCGAACAGAAATTTT
GAAATGGTATCTCAATAAAATAAAGTTTGATCAATCCGTTGATCCAGAAATTATAGCTCGAGG
TACTGTTGGCTTTTCCGGAGCAGAGTTGGAGAATCTTGTGAACCAGGCTGCATTAAAAGCAGC
TGTTGATGGAAAAGAAATGGTTACCATGAAGGAGCTGGAGTTTTCCAAAGACAAAATTCTAAT
GGGGCCTGAAAGAAGAAGTGTGGAAATTGATAACAAAAACAAACCATCACAGCATATCATGA
ATCTGGTCATGCCATTATTGCATATTACACAAAAGATGCAATGCCTATCAACAAAGCTACAAT
CATGCCACGGGGCCAACACTTGGACATGTGTCCCTGTTACCTGAGAATGACAGATGGAATGA
AACTAGAGCCCAGCTGCTTGCACAAATGGATGTTAGTATGGGAGGAAGAGTGGCAGAGGAGCT
TATATTTGGAACCGACCATATTACAACAGGTGCTTCCAGTGATTTTGATAATGCCACTAAAAT
AGCAAAGCGGATGGTTACCAAATTTGGAATGAGTGAAAAGCTTGGAGTTATGACCTACAGTGA
TACAGGGAAACTAAGTCCAGAAACCCAATCTGCCATCGAACAAGAAATAAGAATCCTTCTAAG
GGACTCATATGAACGAGCAAAACATATCTTGAAAACTCATGCAAAGGAGCATAAGAATCTCGC
AGAAGCTTTATTGACCTATGAGACTTTGGATGCCAAAGAGATTCAAATTGTTCTTGAGGGGAA
AAAGTTGGAAGTGAGATGATAACTCTCTTGATATGGATGCTTGCTGGTTTTATTGCAAGAATA
TAAGTAGCATTGCAGTAGTCTACTTTTACAACGCTTTCCCCTCATTCTTGATGTGGTGTAATT
GAAGGGTGTGAAATGCTTTGTCAATCATTTGTCACATTTATCCAGTTTGGGTTATTCTCATTA
TGACACCTATTGCAAATTAGCATCCCATGGCAAATATATTTTGAAAAAATAAAGAACTATCAG
GATTGAAAACAAAAAAAAAAAA
```

FIGURE 96

MFSLSSTVQPQVTVPLSHLINAFHTPKNTSVSLSGVSVSQNQHRDVVPEHEAPSSEPSLNLRD
LGLSELKIGQIDQLVENLLPGFCKGKNISSHWHTSHVSAQSFFENKYGNLDIFSTLRSSCLYR
HHSRALQSICSDLQYWPVFIQSRGFKTLKSRTRRLQSTSERLAETQNIAPSFVKGFLLRDRGS
DVESLDKLMKTKNIPEAHQDAFKTGFAEGFLKAQALTQKTNDSLRRTRLILFVLLLFGIYGLL
KNPFLSVRFRTTTGLDSAVDPVQMKNVTFEHVKGVEEAKQELQEVVEFLKNPQKFTILGGKLP
KGILLVGPPGTGKTLLARAVAGEADVPFYYASGSEFDEMFVGVGASRIRNLFREAKANAPCVI
FIDELDSVGGKRIESPMHPYSRQTINQLLAEMDGFKPNEGVIIIGATNFPEALDNALIRPGRF
DMQVTVPRPDVKGRTEILKWYLNKIKFDQSVDPEIIARGTVGFSGAELENLVNQAALKAAVDG
KEMVTMKELEFSKDKILMGPERRSVEIDNKNKTITAYHESGHAIIAYYTKDAMPINKATIMPR
GPTLGHVSLLPENDRWNETRAQLLAQMDVSMGGRVAEELIFGTDHITTGASSDFDNATKIAKR
MVTKFGMSEKLGVMTYSDTGKLSPETQSAIEQEIRILLRDSYERAKHILKTHAKEHKNLAEAL
LTYETLDAKEIQIVLEGKKLEVR

Important features of the protein:

Transmembrane domain:

amino acids 238-259

N-glycosylation sites.

amino acids 28-32, 90-94, 230-234, 278-282, 535-539, 584-588, 623-627

N-myristoylation sites.

amino acids 35-41, 266-272, 286-292, 325-331, 357-363, 599-605

Amidation site.

amino acids 387-393, 709-713

ATP/GTP-binding site motif A (P-loop).

amino acids 322-330

AAA-protein family proteins amino acids 315-336, 343-386, 405-451

FIGURE 97

```
GATGGCGCAGCCACAGCTTCTGTGAGATTCGATTTCTCCCCAGTTCCCCTGTGGGTCTGAGGG
GACCAGAAGGGTGAGCTACGTTGGCTTTCTGGAAGGGGAGGCTATATGCGTCAATTCCCCAAA
ACAAGTTTTGACATTTCCCCTGAAATGTCATTCTCTATCTATTCACTGCAAGTGCCTGCTGTT
CCAGGCCTTACCTGCTGGGCACTAACGGCGGAGCCAGGATGGGGACAGAATAAAGGAGCCACG
ACCTGTGCCACCAACTCGCACTCAGACTCTGAACTCAGACCTGAAATCTTCTCTTCACGGGAG
GCTTGGCAGTTTTTCTTACTCCTGTGGTCTCCAGATTTCAGGCCTAAGATGAAAGCCTCTAGT
CTTGCCTTCAGCCTTCTCTCTGCTGCGTTTTATCTCCTATGGACTCCTTCCACTGGACTGAAG
ACACTCAATTTGGGAAGCTGTGTGATCGCCACAAACCTTCAGGAAATACGAAATGGATTTTCT
GAGATACGGGGCAGTGTGCAAGCCAAAGATGGAAACATTGACATCAGAATCTTAAGGAGGACT
GAGTCTTTGCAAGACACAAAGCCTGCGAATCGATGCTGCCTCCTGCGCCATTTGCTAAGACTC
TATCTGGACAGGGTATTTAAAAACTACCAGACCCCTGACCATTATACTCTCCGGAAGATCAGC
AGCCTCGCCAATTCCTTTCTTACCATCAAGAAGGACCTCCGGCTCTCTCATGCCCACATGACA
TGCCATTGTGGGGAGGAAGCAATGAAGAAATACAGCCAGATTCTGAGTCACTTTGAAAAGCTG
GAACCTCAGGCAGCAGTTGTGAAGGCTTTGGGGGAACTAGACATTCTTCTGCAATGGATGGAG
GAGACAGAATAGGAGGAAAGTGATGCTGCTGCTAAGAATATTCGAGGTCAAGAGCTCCAGTCT
TCAATACCTGCAGAGGAGGCATGACCCCAAACCACCATCTCTTTACTGTACTAGTCTTGTGCT
GGTCACAGTGTATCTTATTTATGCATTACTTGCTTCCTTGCATGATTGTCTTTATGCATCCCC
AATCTTAATTGAGACCATACTTGTATAAGATTTTTGTAATATCTTTCTGCTATTGGATATATT
TATTAGTTAATATATTTATTTATTTTTGCTATTTAATGTATTTATTTTTTACTTGGACATG
AAACTTTAAAAAAATTCACAGATTATATTTATAACCTGACTAGAGCAGGTGATGTATTTTTAT
ACAGTAAAAAAAAAAAACCTTGTAAATTCTAGAAGAGTGGCTAGGGGGGTTATTCATTTGTAT
TCAACTAAGGACATATTTACTCATGCTGATGCTCTGTGAGATATTTGAAATTGAACCAATGAC
TACTTAGGATGGGTTGTGGAATAAGTTTTGATGTGGAATTGCACATCTACCTTACAATTACTG
ACCATCCCCAGTAGACTCCCCAGTCCCATAATTGTGTATCTTCCAGCCAGGAATCCTACACGG
CCAGCATGTATTTCTACAAATAAAGTTTTCTTTGCATACCAAAAAAAAAAAAAAAAAAA
```

FIGURE 98

MKASSLAFSLLSAAFYLLWTPSTGLKTLNLGSCVIATNLQEIRNGFSEIRGSVQAKDGNIDIR
ILRRTESLQDTKPANRCCLLRHLLRLYLDRVFKNYQTPDHYTLRKISSLANSFLTIKKDLRLC
HAHMTCHCGEEAMKKYSQILSHFEKLEPQAAVVKALGELDILLQWMEETE

Signal sequence:
amino acids 1-24 cAMP- and cGMP-dependent protein kinase phosphorylation sites.
amino acids 107-110, 140-143

N-myristoylation site.
amino acids 51-56

Interleukin 10:
amino acids 9-176

FIGURE 99

```
GCGCCGGCTCCGCGCCTCGCGCCCAGTCCGCGGGCCGCGCCGCCGCTCCCGCCGCTCCCGCCG
CTCCCGCAGCCGCCCCGCCGCCCGCCCGGAGCCCCGCGTCCCTAGGCCTGGCTCCCGCCTGCC
CGAGACCCGCCCAGCCTGCCCCGCTCAGCCGCCAGAGAAGATGCGGCTGCTCCCGGAATGGTT
CCTCTTGCTCTTTGGCCCGTGGCTCCTTAGGAAGGCCGTCAGTGCCCAGATACCAGAGTCCGG
AAGGCCGCAGTACCTGGGGCTGCGCCCCGCCGCGGCCGGAGCGGGTGCCCCGGCCAGCAGCT
CCCAGAGCCAAGGTCTTCGGACGGCCTAGGCGTGGGCCGCGCCTGGAGCTGGGCCTGGCCGAC
CAACCACACGGGGGCGCTGGCCCGGGCAGGGGCAGCCGGGGCGTTGCCCGCGCAGCGCACCAA
GAGGAAGCCGTCCATCAAGGCGGCGCGCGCCAAAAAGATCTTCGGCTGGGGGACTTCTACTT
TCGGGTGCATACCCTCAAGTTTTCGCTGCTGGTGACCGGCAAGATCGTGGACCATGTGAACGG
TACCTTCAGTGTGTATTTCCGCCACAACTCGTCCAGCCTGGGCAACCTCAGTGTCAGCATCGT
GCCGCCCTCCAAGCGTGTCGAGTTCGGAGGAGTCTGGCTGCCCGGGCCTGTCCCCCACCCTCT
GCAGTCTACGCTCGCCCTGGAGGGGGTGCTTCCTGGGCTGGGGCCCCGCTGGGGATGGCAGC
AGCAGCGGCGGGGCCGGGGCTTGGGGGCTCCCTCGGGGGCGCACTGGCGGGGCCGCTTGGGGG
CGCGTTGGGAGTGCCTGGGGCCAAAGAGTCACGCGCTTTCAATTGCCACGTGGAGTATGAGAA
GACAAACCGCGCGCGCAAGCACCGACCGTGCCTGTACGACCCGTCGCAGGTGTGTTTCACCGA
GCACACGCAGAGCCAGGCCGCCTGGCTCTGTGCCAAGCCCTTCAAAGTCATCTGTATCTTCGT
CTCTTTCCTCAGCTTTGACTACAAACTGGTGCAGAAGGTGTGCCCAGACTATAACTTCCAGAG
TGAGCACCCCTACTTCGGATAGCGCCCCTCCCCAGCCAGTCCTGAGCCTCCCGCCAAATCCCA
GCCTCACTAGGTGGGACCCCCTTCCCAGTGTTCTGCCGCTCCTGTGGCCATGTCGCCCACTCC
TTCCACTCTGGGGGCGGAGGGGAATGGCTTCTCGGGACCCTCAGCTAGCGTGGGTGCCCTTTT
CCTTATGCGGAGTGCCCGCAAGGCTGGGGTAGCCCCCTCCAGTACACCCCAAAGTGAAAGGGA
TAAGAGTGCAGCCCCAGAATAGGCGGGGCTTGGAGGCGGTCCCAATGTCCCCTGGGTCCACAG
TGGGTCCCCTTTTCACCCTTGGCGCTAGGCTGCGCACTCCCTTTCCCCGCAGCTTTAATAACT
CCTGGCCTGGCACCCTCACCCCACCCTGACTTTCCCATCCCCCAGCGCTTGTCCTGCTTCACC
ATACCCCGCCTAAGACTGTAAAGGCCTAAAAACCTCGGCCTGTCCTCCCACCATTCTGCCTGC
CATATGCCTGTCCCCTTTTCCTCCAAACCCTATTAGGGTACCGGAAGCAGAACCCCTGGGCTG
AGGCCCTGGCCCTGCCCCGGCCCCTGCCCTGCCCGCCCCCTCCAGTCCAGGCAGTCGAGC
TCCACCTGCCCTCTCCTGCTGCTTCCTCTCGGTGATATTTTTTCTACGCCAAAACAGACGGGA
AAGGGAACAAAATAAAGTGAAATCCCAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAA
AAAAAAAAAAAAAA
```

FIGURE 100

MRLLPEWFLLLFGPWLLRKAVSAQIPESGRPQYLGLRPAAAGAGAPGQQLPEPRSSDGLGVGR
AWSWAWPTNHTGALARAGAAGALPAQRTKRKPSIKAARAKKIFGWGDFYFRVHTLKFSLLVTG
KIVDHVNGTFSVYFRHNSSSLGNLSVSIVPPSKRVEFGGVWLPGPVPHPLQSTLALEGVLPGL
GPPLGMAAAAAGPGLGGSLGGALAGPLGGALGVPGAKESRAFNCHVEYEKTNRARKHRPCLYD
PSQVCFTEHTQSQAAWLCAKPFKVICIFVSFLSFDYKLVQKVCPDYNFQSEHPYFG

Important features of the protein:

Signal peptide:
amino acids 1-22

Transmembrane domain:
amino acids 273-288

N-glycosylation sites.
amino acids 72-76, 133-137, 143-147, 149-153 cAMP- and cGMP-dependent protein kinase phosphorylation site.
amino acids 93-97

N-myristoylation sites.
amino acids 35-41, 58-64, 60-66, 81-87, 84-90, 184-190, 194-200,
203-209, 205-211, 206-212, 209-215, 217-223, 221-227, 224-230

Cytochrome b/b6 Qo site signature.
amino acids 5-11

FIGURE 101

AATGCCCCATGCGCACCCCACAGCTCGCGCTCCTGCAAGTGTTCTTTCTGGTGTTCCCCGATG
GCGTCCGGCCTCAGCCCTCTTCCTCCCCATCAGGGGCAGTGCCCACGTCTTTGGAGCTGCAGC
GAGGGACGGATGGCGGAACCCTCCAGTCCCCTTCAGAGGCGACTGCAACTCGCCCGGCCGTGC
CTGGACTCCCTACAGTGGTCCCTACTCTCGTGACTCCCTCGGCCCCTGGGAATAGGACTGTGG
ACCTCTTCCCAGTCTTACCGATCTGTGTCTGTGACTTGACTCCTGGAGCCTGCGATATAAATT
GCTGCTGCGACAGGGACTGCTATCTTCTCCATCCGAGGACAGTTTTCTCCTTCTGCCTTCCAG
GCAGCGTAAGGTCTTCAAGCTGGGTTTGTGTAGACAACTCTGTTATCTTCAGGAGTAATTCCC
CGTTTCCTTCAAGAGTTTTCATGGATTCTAATGGAATCAGGCAGTTTTGTGTCCATGTGAACA
ACTCAAACTTAAACTATTTCCAGAAGCTTCAAAAGGTCAATGCAACCAACTTCCAGGCCCTGG
CTGCAGAGTTTGGAGGCGAATCATTCACTTCAACATTCCAAACTCAATCACCACCATCTTTTT
ACAGGGCTGGGGACCCCATTCTTACTTACTTCCCCAAGTGGTCTGTAATAAGCTTGCTGAGAC
AACCTGCAGGAGTTGGAGCTGGGGACTCTGTGCTGAAAGCAATCCTGCAGGTTTCCTAGAGA
GTAAAAGTACAACTTGCACTCGTTTTTTCAAGAACCTGGCTAGTAGCTGTACCTTGGATTCAG
CCCTCAATGCTGCCTCTTACTATAACTTCACAGTCTTAAAGGTTCCAAGAAGCATGACTGATC
CACAGAATATGGAGTTCCAGGTTCCTGTAATACTTACCTCACAGGCTAATGCTCCTCTGTTGG
CTGGAAACACTTGTCAGAATGTAGTTTCTCAGGTCACCTATGAGATAGAGACCAATGGGACTT
TTGGAATCCAGAAAGTTTCTGTCAGTTTGGGACAAACCAACCTGACTGTTGAGCCAGGCGCTT
CCTTACAGCAACACTTCATCCTTCGCTTCAGGGCTTTTCAACAGAGCACAGCTGCTTCTCTCA
CCAGTCCTAGAAGTGGGAATCCTGGCTATATAGTTGGGAAGCCACTCTTGGCTCTGACTGATG
ATATAAGTTACTCAATGACCCTCTTACAGAGCCAGGGTAATGGAAGTTGCTCTGTTAAAAGAC
ATGAAGTGCAGTTTGGAGTGAATGCAATATCTGGATGCAAGCTCAGGTTGAAGAAGGCAGACT
GCAGCCACTTGCAGCAGGAGATTTATCAGACTCTTCATGGAAGGCCCAGACCAGAGTATGTTG
CCATCTTTGGTAATGCTGACCCAGCCCAGAAAGGAGGGTGGACCAGGATCCTCAACAGGCACT
GCAGCATTTCAGCTATAAACTGTACTTCCTGCTGTCTCATACCAGTTTCCCTGGAGATCCAGG
TATTGTGGGCATATGTAGGTCTCCTGTCCAACCCGCAAGCTCATGTATCAGGAGTTCGATTCC
TATACCAGTGCCAGTCTATACAGGATTCTCAGCAAGTTACAGAAGTATCTTTGACAACTCTTG
TGAACTTTGTGGACATTACCCAGAAGCCACAGCCTCCAAGGGGCCAACCCAAAATGGACTGGA
AATGGCCATTCGACTTCTTTCCCTTCAAAGTGGCATTCAGCAGAGGAGTATTCTCTCAAAAAT
GCTCAGTCTCTCCCATCCTTATCCTGTGCCTCTTACTACTTGGAGTTCTCAACCTAGAGACTA
TGTGAAGAAAAGAAAATAATCAGATTTCAGTTTTCCCTATGAGAAACTCTGAGGCAGCCACTT
ATCTTGGCTAAATAGAACCTCACCTGCTCATGACCAGAGAGCATTTAGGATAATAGATGACCT
AACTGAAGGAATCCTTGTATATGAAAGGAGTTATTTTAGAAAAGCAATAAAAATATTTTATTC
ATCNTAAAAAAAAAA

FIGURE 102

MRTPQLALLQVFFLVFPDGVRPQPSSSPSGAVPTSLELQRGTDGGTLQSPSEATATRPAVPGL
PTVVPTLVTPSAPGNRTVDLFPVLPICVCDLTPGACDINCCCDRDCYLLHPRTVFSFCLPGSV
RSSSWVCVDNSVIFRSNSPFPSRVFMDSNGIRQFCVHVNNSNLNYFQKLQKVNATNFQALAAE
FGGESFTSTFQTQSPPSFYRAGDPILTYFPKWSVISLLRQPAGVGAGGLCAESNPAGFLESKS
TTCTRFFKNLASSCTLDSALNAASYYNFTVLKVPRSMTDPQNMEFQVPVILTSQANAPLLAGN
TCQNVVSQVTYEIETNGTFGIQKVSVSLGQTNLTVEPGASLQQHFILRFRAFQQSTAASLTSP
RSGNPGYIVGKPLLALTDDISYSMTLLQSQGNGSCSVKRHEVQFGVNAISGCKLRLKKADCSH
LQQEIYQTLHGRPRPEYVAIFGNADPAQKGGWTRILNRHCSISAINCTSCCLIPVSLEIQVLW
AYVGLLSNPQAHVSGVRFLYQCQSIQDSQQVTEVSLTTLVNFVDITQKPQPPRGQPKMDWKWP
FDFFPFKVAFSRGVFSQKCSVSPILILCLLLLGVLNLETM

Important features of the protein:
Signal peptide:
amino acids 1-22

Transmembrane domains:
amino acids 484-505, 581-600

N-glycosylation sites.
amino acids 78-82, 165-169, 179-185, 279-285, 331-337, 347-351, 410-414, 487-491

N-myristoylation sites.
amino acids 30-36, 41-47, 124-130, 232-238, 236-242, 409-415

Prokaryotic membrane lipoprotein lipid attachment site.
amino acids 420-431

FIGURE 103

```
CCTAATTCTCAAGGTGATGCTATTTAGGAAGTCATAACTCATGTGAGTGGAGCCATGTGGGAT
TAAGAAGTGATAGGAGAGCTTGCTGTCTGTCTCTGCTCTCCACTGTGTGAGGATACAACAGGA
AGACAGCCATCTGGTGAGGAAGAGAGGGCCCTCGCCAGATACCGGACCTGCTGACACCTTGAT
CTTGGACTTCCCATCTTCCAGGAAGGCCTGACCTCAGTTGTTCCAGGGTAAAGAATTTGGGCA
GTGCCCACACCCACGCTGTTGGATAACATTTCTTCACCATACCAGTGAGGGTGAATGTGTACA
CGCCCAGCTTCCTGCCTGTTACTCTCCACAGTATGCGAAGAATATCCCTGACTTCTAGCCCTG
TGCGCCTTCTTTTGTTTCTGCTGTTGCTACTAATAGCCTTGGAGATCATGGTTGGTGGTCACT
CTCTTTGCTTCAACTTCACTATAAAATCATTGTCCAGACCTGGACAGCCCTGGTGTGAAGCGC
AGGTCTTCTTGAATAAAAATCTTTTCCTTCAGTACAACAGTGACAACAACATGGTCAAACCTC
TGGGCCTCCTGGGGAAGAAGGTATATGCCACCAGCACTTGGGGAGAATTGACCCAAACGCTGG
GAGAAGTGGGGCGAGACCTCAGGATGCTCCTTTGTGACATCAAACCCCAGATAAAGACCAGTG
ATCCTTCCACTCTGCAAGTCGAGATGTTTTGTCAACGTGAAGCAGAACGGTGCACTGGTGCAT
CCTGGCAGTTCGCCACCAATGGAGAGAAATCCCTCCTCTTTGACGCAATGAACATGACCTGGA
CAGTAATTAATCATGAAGCCAGTAAGATCAAGGAGACATGGAAGAAAGACAGAGGGCTGGAAA
AGTATTTCAGGAAGCTCTCAAAGGGAGACTGCGATCACTGGCTCAGGGAATTCTTAGGGCACT
GGGAGGCAATGCCAGAACCGACAGGCAGAAGATCCACCTAGAGGTGATACCACGGCGGCGCAG
AGTTGTTCACCTGTGGTCCTCGATCGCTGACAGCCTTGGCTCCCACTGCTGTGTGTTCCCTGA
GTCAAGTGGAGGCGGAGCCTGCAATGAGCGGAGATCGCGCCTCTGCATTCCAGTCTTGGCAAC
AGAGCAAGACTCCGTCTCAAAAAAAAAAAATTTTTTTCAGTACATATTTTTAAAAGATAGG
GCTGGGCACAGCAGCTCACATCTATAATCCCAACACTTTGGGAGGCCTAGGCAGGAGGATCAC
TTGAGCCCAGGAATCTGAAGCTGCAGTGAGCCTTTGCTCGTGAGATTGTGGACCTATGATCCT
ACCACCAGCCCACCTGGTTCTAACACCCCCTCCTCTATGTGTGAGAGGGAGAGAAGAAAAGTG
AGGGAGAAAAGAGAGATAAGCAAAGAACAGAGAGGAAAAATGGAAAATAAGAGGAAATTGGGG
GAATTAAACAGAGGGGAGGGCATGGATCCCCGGGAGTTAGAAGAGTAGCAGCTTGTGGATTAC
TACGCAGTGGAGGAAGAAGAGTTGTTGGAAATTATTTGAGAGGTAGTATAATCATTTGTGAGG
CAGTTTTCTGCATTCACCATTTCTCACAGACTAAGTTACTCATAAGCAAACGTGCAATTCACA
TTACACTGAAATTCTTCCCTAATACATCATTTGCATTGGAATAAAGTACGGTTTTCAAACAAC
CTGATATAGCAGAACTGACTGTATAAATTATGTGAGCACAGTGCAAGTAATTCTTTGTTTGTT
TGTTTGTTTTTTTGAGACAGAGTCTCACTCTATCTCCCAGGCTGGAGTGTAGTGGTGCGATCC
CGGCTCACTGCAACCTCGATCTCCCAGGCTCAAGCGATTCCCCTGCCTCAGCCTCCTGAGTAG
CTGGGATTACAGGCATGAGCCACCACGCCCGGCTAATTTTTGTATTTTTAGTAGAGACGGGGT
TTCACCCTGTTGGCCAGGCTGGTCTCGAACTACGGACCTCAGGTGATCTGCCCCCCTCAGCCT
CTCAAAGTGCTGGGATTATAGCATGAGCCACTGAGCCCAGACACAAGTAGTTCTTTCTGATAA
ACACTTTAACACTGAATGCA
```

FIGURE 104

MRRISLTSSPVRLLLFLLLLLIALEIMVGGHSLCFNFTIKSLSRPGQPWCEAQVFLNKNLFLQ
YNSDNNMVKPLGLLGKKVYATSTWGELTQTLGEVGRDLRMLLCDIKPQIKTSDPSTLQVEMFC
QREAERCTGASWQFATNGEKSLLFDAMNMTWTVINHEASKIKETWKKDRGLEKYFRKLSKGDC
DHWLREFLGHWEAMPEPTGRRST

Important features of the protein:

Signal peptide:

amino acids 1-23

Transmembrane domain:

amino acids 11-30(possible type II protein)

N-glycosylation site.

amino acids 36-39, 154-157 cAMP- and cGMP-dependent protein kinase phosphorylation site.

amino acids 2-5, 182-185, 209-212

Casein kinase II phosphorylation site.

amino acids 86-89, 93-96, 142-145, 185-188

N-myristoylation site.

amino acids 46-51

Amidation site.

amino acids 77-80, 207-210

FIGURE 105

TTTTCCGAGTGACCTTCTTGATGCTGGCTGTTTCTCTCACCGTTCCCCTGCTTGGAGCCATGA
TGCTGCTGGAATCTCCTATAGATCCACAGCCTCTCAGCTTCAAAGAACCCCCGCTCTTGCTTG
GTGTTCTGCATCCAAATACGAAGCTGCGACAGGCAGAAAGGCTGTTTGAAAATCAACTTGTTG
GACCGGAGTCCATAGCACATATTGGGGATGTGATGTTTACTGGGACAGCAGATGGCCGGGTCG
TAAAACTTGAAAATGGTGAAATAGAGACCATTGCCCGGTTTGGTTCGGGCCCTTGCAAAACCC
GAGATGATGAGCCTGTGTGTGGGAGACCCCTGGGTATCCGTGCAGGGCCCAATGGGACTCTCT
TTGTGGCCGATGCATACAAGGGACTATTTGAAGTAAATCCCTGGAAACGTGAAGTGAAACTGC
TGCTGTCCTCCGAGACACCCATTGAGGGGAAGAACATGTCCTTTGTGAATGATCTTACAGTCA
CTCAGGATGGGAGGAAGATTTATTTCACCGATTCTAGCAGCAAATGGCAAAGACGAGACTACC
TGCTTCTGGTGATGGAGGGCACAGATGACGGGCGCCTGCTGGAGTATGATACTGTGACCAGGG
AAGTAAAAGTTTTATTGGACCAGCTGCGGTTCCCGAATGGAGTCCAGCTGTCTCCTGCAGAAG
ACTTTGTCCTGGTGGCAGAAACAACCATGGCCAGGATACGAAGAGTCTACGTTTCTGGCCTGA
TGAAGGGCGGGGCTGATCTGTTTGTGGAGAACATGCCTGGATTTCCAGACAACATCCGGCCCA
GCAGCTCTGGGGGGTACTGGGTGGGCATGTCGACCATCCGCCCTAACCCTGGGTTTTCCATGC
TGGATTTCTTATCTGAGAGACCCTGGATTAAAAGGATGATTTTTAAGCTCTTTAGTCAAGAGA
CGGTGATGAAGTTTGTGCCGCGGTACAGCCTCGTCCTAGAACTCAGCGACAGCGGTGCCTTCC
GGAGAAGCCTGCATGATCCCGATGGGCTGGTGGCCACCTACATCAGCGAGGTGCACGAACACG
ATGGGCACCTGTACCTGGGCTCTTTCAGGTCCCCCTTCCTCTGCAGACTCAGCCTCCAGGCTG
TTTAGCCCTCCCAGATAGCTGCCCCTGCCACGCAGGCCAGGAGTCTTCACACTCAGGCACCAG
GCCTGGTCCAGGAGGAGCTGTGGACACAGTCGTGGTTCAAGTGTCCACATGCACCTGTTAGTC
CCTGAGAGGTGGTGGGAATGGCTGCTTCATTCCTCGAGGATGCCCGGGCCCCACCTGGGCTTG
TCTTTCTGTTTAGAGGGAAGTGTAACATATCTGCCATGAGGAACATAAATTCATGTAAAGCCA
TTTTCTCTTAAACAAAACAAAACTTTCTAAGTACAATCATTCTCTAGGATTTGGGAAGCTCCT
TGCACTTGGAACAGGGCTCAGGTGGGTGGAGCAGTAAGGCACTACCCAGAGAGCTTGCTGCTG
CGGCCCTGTCCTGCGGCCTCAAAGTTCTTCTTTACTATATATAACGTGCGGTCATACCTTTCT
TCGTTGTGGTGGGGATGGAAGAGCAGAGGGAGCATGGCCCAGGGGTGTTGAGGCCAGCGGTGA
GAGCCGTGTTAGCCAAGACATGGAACTGTGTTCTCAAGGGTTATGTGGGGCGTGGGCTCTCCA
TAGTGTGTATGAAAAGCTTGTTGACTCTAGCGGCTCAGAGAGGACTTTGCTGGGTTTCTTTCT
GTGAATATCTCCGTGCTGACCATGCTGGAATTGGATGATTCTGCAATTCGGGACCTACTGCAG
GGGTCCGTTTAGTAACGTCTTGTCTGTGATCTTTGTTCTTGACCTCTAGACCCCAAGATGTGA
ACAGTGCACGTGTTAATGTCATCTTTGCTCATGTGTTATAAGCCCCAAGTTGCTGTATATTTT
CACAAGTATGTCTACACACTGG

FIGURE 106

MLAVSLTVPLLGAMMLLESPIDPQPLSFKEPPLLLGVLHPNTKLRQAERLFENQLVGPESIAH
IGDVMFTGTADGRVVKLENGEIETIARFGSGPCKTRDDEPVCGRPLGIRAGPNGTLFVADAYK
GLFEVNPWKREVKLLLSSETPIEGKNMSFVNDLTVTQDGRKIYFTDSSSKWQRRDYLLLVMEG
TDDGRLLEYDTVTREVKVLLDQLRFPNGVQLSPAEDFVLVAETTMARIRRVYVSGLMKGGADL
FVENMPGFPDNIRPSSSGGYWVGMSTIRPNPGFSMLDFLSERPWIKRMIFKLFSQETVMKFVP
RYSLVLELSDSGAFRRSLHDPDGLVATYISEVHEHDGHLYLGSFRSPFLCRLSLQAV

Important features of the protein:

Signal peptide:

amino acids 1-13

Transmembrane domain:

amino acids 1-21 (possible type II)

N-glycosylation sites.

amino acids 116-119, 152-155

Casein kinase II phosphorylation sites.

amino acids 19-22, 27-30, 98-101, 146-149, 221-224, 286-289, 332-335

N-myristoylation sites.

amino acids 71-76, 92-97, 189-194, 244-249, 338-343

Amidation site.

amino acids 164-167

FIGURE 107

```
AACGAAGCGTGCGCGCTTTGGTAACCGGCTAGAAATCCCGCACGCGCGCCTGCCTCCTCTCCC
CAGGCCTGAGCTGCCCCTCCCACTGCCTTTCCTTCTTCCCGCGAGTCAGAAGCTTCGCGAGGG
CCCAGAGAGGCGGTGGGGTGGGCGACCCTACGCCAGCTCCGGGCGGGAGAAAGCCCACCCTCT
CCCGCGCCCCAGGAAACCGCCGGCGTTCGGCGCTGCGCAGAGCCATGGAATTCTCCTGGCTGG
AGACGCGCTGGGCGCGGCCCTTTTACCTGGCGTTCGTGTTCTGCCTGGCCCTGGGGCTGCTGC
AGGCCATTAAGCTGTACCTGCGGAGGCAGCGGCTGCTGCGGGACCTGCGCCCCTTCCCAGCGC
CCCCCACCCACTGGTTCCTTGGGCACCAGAAGTTTATTCAGGATGATAACATGGAGAAGCTTG
AGGAAATTATTGAAAAATACCCTCGTGCCTTCCCTTTCTGGATTGGGCCCTTTCAGGCATTTT
TCTGTATCTATGACCCAGACTATGCAAAGACACTTCTGAGCAGAACAGATCCAAGTCCCAGT
ACCTGCAGAAATTCTCACCTCCACTTCTTGGAAAAGGACTAGCGGCTCTAGACGGACCCAAGT
GGTTCCAGCATCGTCGCCTACTAACTCCTGGATTCCATTTTAACATCCTGAAAGCATACATTG
AGGTGATGGCTCATTCTGTGAAAATGATGCTGGATAAGTGGGAGAAGATTTGCAGCACTCAGG
ACACAAGCGTGGAGGTCTATGAGCACATCAACTCGATGTCTCTGGATATAATCATGAAATGCG
CTTTCAGCAAGGAGACCAACTGCCAGACAAACAGCACCCATGATCCTTATGCAAAAGCCATAT
TTGAACTCAGCAAAATCATATTTCACCGCTTGTACAGTTTGTTGTATCACAGTGACATAATTT
TCAAACTCAGCCCTCAGGGCTACCGCTTCCAGAAGTTAAGCCGAGTGTTGAATCAGTACACAG
ATACAATAATCCAGGAAAGAAAGAAATCCCTCCAGGCTGGGGTAAAGCAGGATAACACTCCGA
AGAGGAAGTACCAGGATTTTCTGGATATTGTCCTTTCTGCCAAGGATGAAAGTGGTAGCAGCT
TCTCAGATATTGATGTACACTCTGAAGTGAGCACATTCCTGTTGGCAGGACATGACACCTTGG
CAGCAAGCATCTCCTGGATCCTTTACTGCCTGGCTCTGAACCCTGAGCATCAAGAGAGATGCC
GGGAGGAGGTCAGGGGCATCCTGGGGGATGGGTCTTCTATCACTTGGGACCAGCTGGGTGAGA
TGTCGTACACCACAATGTGCATCAAGGAGACGTGCCGATTGATTCCTGCAGTCCCGTCCATTT
CCAGAGATCTCAGCAAGCCACTTACCTTCCCAGATGGATGCACATTGCCTGCAGGGATCACCG
TGGTTCTTAGTATTTGGGGTCTTCACCACAACCCTGCTGTCTGGAAAAACCCAAAGGTCTTTG
ACCCCTTGAGGTTCTCTCAGGAGAATTCTGATCAGAGACACCCCTATGCCTACTTACCATTCT
CAGCTGGATCAAGGAACTGCATTGGGCAGGAGTTTGCCATGATTGAGTTAAAGGTAACCATTG
CCTTGATTCTGCTCCACTTCAGAGTGACTCCAGACCCCACCAGGCCTCTTACTTTCCCCAACC
ATTTTATCCTCAAGCCCAAGAATGGGATGTATTTGCACCTGAAGAAACTCTCTGAATGTTAGA
TCTCAGGGTACAATGATTAAACGTACTTTGTTTTTCGAAGTTAAATTTACAGCTAATGATCCA
AGCAGATAGAAAGGGATCAATGTATGGTGGGAGGATTGGAGGTTGGTGGGATAGGGTCTCTG
TGAAGAGATCCAAAATCATTTCTAGGTACACAGTGTGTCAGCTAGATCTGTTTCTATATAACT
TTGGGAGATTTTCAGATCTTTTCTGTTAAACTTTCACTACTATTAATGCTGTATACACCAATA
GACTTTCATATATTTTCTGTTGTTTTTAAAATAGTTTTCAGAATTATGCAAGTAATAAGTGCA
TGTATGCTCACTGTCAAAAATTCCCAACACTAGAAAATCATGTAGAATAAAAATTTTAAATCT
CACTTCACTTAGCCGACATTCCATGCCCTGACCAATCCTACTGCTTTTCCTAAAAACAGAATA
ATTTGGTGTGCATTCTTTCAGACTTTTTCCTATACATTTATATGTAGAAATGTAGCAATGTA
TTTGTATAGATGTGATCATTCCTATATTGTTATTGATTTTTTTCACTTAATAAAAATTCACCT
TATTCCTTAAAA
```

FIGURE 108

```
MEFSWLETRWARPFYLAFVFCLALGLLQAIKLYLRRQRLLRDLRPFPAPPTHWFLGHQKFIQD
DNMEKLEEIIEKYPRAFPFWIGPFQAFFCIYDPDYAKTLLSRTDPKSQYLQKFSPPLLGKGLA
ALDGPKWFQHRRLLTPGFHFNILKAYIEVMAHSVKMMLDKWEKICSTQDTSVEVYEHINSMSL
DIIMKCAFSKETNCQTNSTHDPYAKAIFELSKIIFHRLYSLLYHSDIIFKLSPQGYRFQKLSR
VLNQYTDTIIQERKKSLQAGVKQDNTPKRKYQDFLDIVLSAKDESGSSFSDIDVHSEVSTFLL
AGHDTLAASISWILYCLALNPEHQERCREEVRGILGDGSSITWDQLGEMSYTTMCIKETCRLI
PAVPSISRDLSKPLTFPDGCTLPAGITVVLSIWGLHHNPAVWKNPKVFDPLRFSQENSDQRHP
YAYLPFSAGSRNCIGQEFAMIELKVTIALILLHFRVTPDPTRPLTFPNHFILKPKNGMYLHLK
KLSEC
```

Important features of the protein:

Signal peptide:

amino acids 1-29

Transmembrane domains:

amino acids 310-330, 397-413, 459-473

N-glycosylation site.

amino acids 206-210 cAMP- and cGMP-dependent protein kinase phosphorylation site.

amino acids 265-269, 504-520

N-myristoylation sites.

amino acids 25-31, 298-304, 353-359, 450-456, 456-462

Cytochrome P450 cysteine heme-iron ligand signature.

amino acids 447-457

Cytochrome P450 cysteine heme-iron ligand proteins.

amino acids 444-475

FIGURE 109

GGCGTTCCGGGCCTCAACTTTGGCGTCGTGAGATTCTTGTGAGGCGTCTGCCTGGAAGCCGGC
AGCAATTTGCTTCTTTAAAGAGAAAAAGAAGGCTAGGGACTCAGATTCCTGGATTCTGAGAT
CCAGACCAGCTCCTCCCAGACCTCTCCAGAAGAAGCCATGGGAACCCCTCGTATCCAGCATTT
GCTGATCCTCCTGGTCCTAGGAGCCTCCCTCCTGACCTCGGGCCTAGAGCTGTATTGTCAAAA
GGGTCTGTCCATGACTGTGGAAGCAGATCCAGCCAATATGTTTAACTGGACCACAGAGGAAGT
GGAGACTTGTGACAAAGGGGCACTTTGCCAGGAAACCATACTAATAATTAAAGCAGGGACTGA
GACAGCCATTTTGGCCACGAAGGGCTGCATCCCGGAAGGGGAGGAGGCCATAACAATTGTCCA
GCACTCTTCACCTCCCGGCCTGATCGTGACCTCCTACAGTAACTACTGTGAGGATTCCTTCTG
TAATGACAAAGACAGCCTGTCTCAGTTTTGGGAGTTCAGTGAGACCACAGCTTCCACTGTGTC
AACAACCCTCCATTGTCCAACCTGTGTGGCTTTGGGGACCTGTTTCAGTGCTCCTTCTCTTCC
CTGTCCCAATGGTACAACTCGATGCTATCAAGGAAAACTTGAGATCACTGGAGGTGGCATTGA
GTCGTCTGTGGAGGTCAAAGGCTGTACAGCCATGATTGGCTGCAGGCTGATGTCTGGAATCTT
AGCAGTAGGACCCATGTTTGTGAGGGAAGCGTGCCCACATCAGCTGCTCACTCAACCTCGAAA
GACTGAAAATGGGGCCACCTGTCTTCCCATTCCTGTTTGGGGGTTACAGCTACTGCTGCCATT
GCTGCTGCCATCATTTATTCACTTTTCCTAAGAAGGCACTTCTGGGCCTGGGTCTGAGGACAT
CTTTTTTGACTGGGAGCCTTCTTACTGTTGAGGTTCAACAAGCTGAGGAGTAGATGGGAATTT
GAGGGAGAATACAGAGATACTATGAACGTATTTGACATTTTTAATACAATTTCTGCTATAATT
TTTGTATGCAGTAGGCGTTACTAATAAACATTTCTGCTGTGA

FIGURE 110

MGTPRIQHLLILLVLGASLLTSGLELYCQKGLSMTVEADPANMFNWTTEEVETCDKGALCQET
ILIIKAGTETAILATKGCIPEGEEAITIVQHSSPPGLIVTSYSNYCEDSFCNDKDSLSQFWEF
SETTASTVSTTLHCPTCVALGTCFSAPSLPCPNGTTRCYQGKLEITGGGIESSVEVKGCTAMI
GCRLMSGILAVGPMFVREACPHQLLTQPRKTENGATCLPIPVWGLQLLLPLLLPSFIHFS

Important features of the protein:

Signal peptide:

amino acids 1-23

Transmembrane domain:

amino acids 184-201

N-glycosylation sites.

amino acids 45-49, 159-163

N-myristoylation sites.

amino acids 31-37, 70-76, 99-105, 147-153, 160-166, 174-180, 175-181

FIGURE 111

```
CGAGAAGAGGACAGAGGAGACTGAGCAAAGGGGGTGGGCTCCAGGCGACCCCTAGCCCAATTCTGCCCCTCCAT
CCCAAGGGGCAGAGAAATTGTCTTTCTTTGCTGACTCCTACGAGGAAAAAAAAAAAAAAAAAAAAAAACCATTTAA
AGGGAAAGATAAACGGAGACGGAGGAAAGGTGGCAGCCAGATTACTTAGAGAGGCACAGAGGAGAGAGATCGGGG
TGAGTCGCCATGGGGACTCCCAGGGCCCAGCACCCGCCGCCTCCCCAGCTGCTGTTCCTAATTCTGCTGAGCTGT
CCCTGGATCCAGGGTCTGCCCCTGAAGGAGGAGGAGATATTGCCAGAGCCTGGAAGTGAGACCCCCACGGTGGCC
TCTGAGGCCCTGGCTGAACTGCTTCATGGGGCCCTGCTGAGGAGGGGCCCAGAGATGGGCTACCTGCCAGGATCT
GATCCGGACCCCACGCTAGCCACCCCTCCGGCCGGCCAGACTCTCGCAGTGCCCTCCCTGCCACGGGCCACTGAG
CCGGGGACAGGGCCTCTGACAACAGCCGTCACCCCTAACGGGGTCAGGGGGGCAGGCCCCACTGCGCCAGAACTG
CTGACCCCGCCCCAGGAACCACAGCCCCACCCCCACCCAGCCCTGCCTCCCCAGGGCCTCCCCTTGGGCCTGAG
GGAGGAGAGGAGGAGACGACGACCACCATCATCACCACGACAACTGTTACCACTACGGTGACCAGCCCAGTTCTG
TGTAATAACAACATCTCCGAGGGCGAAGGGTATGTGGAGTCTCCAGATCTGGGGAGCCCCGTCAGCCGCACCCTG
GGGCTCCTGGACTGCACTTACAGCATCCATGTCTACCCTGGCTACGGCATTGAGATCCAGGTGCAGACGCTGAAC
CTGTCACAGGAAGAGGAGCTCCTGGTGCTGGCTGGTGGGGGATCCCCAGGCCTGGCCCCCCGACTCCTGGCCAAC
TCATCCATGCTTGGAGAAGGACAAGTCCTTCGGAGCCCAACCAACCGGCTGCTTCTGCACTTCCAGAGCCCACGG
GTCCCAAGGGGCGGTGGCTTCAGGATCCACTATCAGGCCTACCTCCTGAGCTGTGGCTTCCCTCCCGGCCGGCC
CATGGGGACGTGAGTGTGACGGACCTGCACCCTGGGGGCACTGCCACCTTTCACTGTGATTCGGGCTACCAGCTG
CAGGGAGAGGAGACCCTCATCTGCCTCAATGGCACCCGGCCATCCTGGAACGGTGAAACCCCCAGCTGCATGGCA
TCCTGTGGTGGCACCATCCACAATGCCACCCTGGGCCGCATCGTGTCCCCAGAGCCTGGGGGAGCCGTAGGGCCC
AACCTCACCTGCCGTTGGGTCATTGAAGCAGCTGAGGGGCGCCGGCTGCACCTGCACTTTGAAAGGGTCTCGCTG
GATGAGGACAATGACCGGCTGATGGTGCGCTCAGGGGGCAGCCCCCTATCCCCGTGATCTATGATTCGGACATG
GACGATGTCCCCGAGCGGGGTCTCATCAGTGACGCCCAGTCCCTCTACGTGGAGCTGCTGTCAGAGACACCTGCC
AATCCCCTGCTGTTAAGCCTTCGATTTGAAGCCTTTGAGGAGGATCGCTGCTTCGCCCCCTTCCTGGCACATGGA
AATGTCACTACCACGGACCCTGAGTATCGCCCAGGGGCACTGGCAACCTTCTCGTGCCTCCCAGGATATGCCCTG
GAGCCCCCTGGGCCCCCAATGCCATCGAATGTGTGGATCCCACAGAACCCCACTGGAACGACACAGAGCCGGCC
TGCAAAGCCATGTGTGGAGGGGAGCTGTCGGAACCAGCTGGCGTGGTCCTCTCTCCCGACTGGCCCCAGAGCTAT
AGCCCGGGCCAAGACTGCGTGTGGGCGTGCACGTCCAGGAAGAGAAGCGCATCTTGCTCCAAGTTGAGATATTG
AATGTGCGGGAAGGGGACATGCTGACGCTGTTCGACGGGGACGGTCCCAGCGCCCGAGTCTTGGCCCAGCTGCGG
GGACCTCAGCCGCGCCGCCGCCTTCTCTCCTCTGGGCCCGACCTCACACTGCAGTTTCAGGCACCGCCCGGGCCC
CCAAATCCAGGCCTGGGCCAGGGCTTCGTATTGCACTTCAAAGAGGTCCCGAGGAACGACACGTGCCCCGAGCTG
CCACCTCCGGAGTGGGGCTGGAGAACGGCATCCCACGGGGACCTGATCCGGGGCACGGTGCTCACCTACCAGTGC
GAGCCTGGCTACGAGCTGCTAGGCTCCGACATTCTCACTTGCCAGTGGGACCTGTCTTGGAGCGCCGCGCCGCCC
GCCTGCCAAAAGATCATGACTTGTGCTGACCCTGGCGAGATTGCCAACGGGCACCGCACCGCCTCGGACGCCGGC
TTCCCCGTTGGCTCCCACGTCCAGTACCGCTGCCTGCCAGGGTACAGCCTCGAGGGGGCAGCCATGCTCACCTGC
TACAGCCGGGACACAGGCACACCCAAGTGGAGCGATAGGGTCCCCAAATGCGCCTTGAAGTACGAGCCGTGCCTG
AACCCGGGGGTTCCCGAGAATGGCTACCAGACGCTGTACAAGCACCACTACCAGGCGGGCGAGTCTCTGCGCTTC
TTCTGCTATGAGGGCTTTGAGCTTATCGGCGAGGTCACCATCACCTGTGTGCCCGGCCACCCCTCCCAGTGGACC
AGCCAGCCCCCACTCTGCAAAGTGACCCAGACCACAGATCCATCACGGCAGCTGGAAGGGGGGAACCTGGCCCTG
GCCATCCTGCTGCCTCTAGGCTTGGTCATTGTCCTCGGCAGTGGCGTTTACATCTACTACACCAAGCTTCAGGGA
AAGTCCCTTTTCGGCTTCTCGGGCTCCCACTCCTACAGCCCCATCACCGTGGAGTCGGACTTCAGCAACCCGCTG
TATGAAGCTGGGGATACGCGGGAGTATGAAGTTTCCATCTGAACCCCAAGACTACAGCTGCAGGACCCAGGACGC
CCCTCCCCTCCTCATTCGGGCAGAGGGAAATACGGGACCCGGTCTCTGCCTCCTGGCTGCCCTCCTCCCTGGCTG
TGTAAATAGTCTCCCTATCCCACGAGGGGGCTTTGATGGCCCTGGAGATCCTACAGTAAATAAACCAGCATCCTG
CCGCCCAAAAAA
```

FIGURE 112

```
MGTPRAQHPPPPQLLFLILLSCPWIQGLPLKEEEILPEPGSETPTVASEALAELLHGALLRRG
PEMGYLPGSDPDPTLATPPAGQTLAVPSLPRATEPGTGPLTTAVTPNGVRGAGPTAPELLTPP
PGTTAPPPPSPASPGPPLGPEGGEEETTTTIITTTTVTTTVTSPVLCNNNISEGEGYVESPDL
GSPVSRTLGLLDCTYSIHVYPGYGIEIQVQTLNLSQEEELLVLAGGGSPGLAPRLLANSSMLG
EGQVLRSPTNRLLLHFQSPRVPRGGGFRIHYQAYLLSCGFPPRPAHGDVSVTDLHPGGTATFH
CDSGYQLQGEETLICLNGTRPSWNGETPSCMASCGGTIHNATLGRIVSPEPGGAVGPNLTCRW
VIEAAEGRRLHLHFERVSLDEDNDRLMVRSGGSPLSPVIYDSDMDDVPERGLISDAQSLYVEL
LSETPANPLLLSLRFEAFEEDRCFAPFLAHGNVTTTDPEYRPGALATFSCLPGYALEPPGPPN
AIECVDPTEPHWNDTEPACKAMCGGELSEPAGVVLSPDWPQSYSPGQDCVWGVHVQEEKRILL
QVEILNVREGDMLTLFDGDGPSARVLAQLRGPQPRRRLLSSGPDLTLQFQAPPGPPNPGLGQG
FVLHFKEVPRNDTCPELPPPEWGWRTASHGDLIRGTVLTYQCEPGYELLGSDILTCQWDLSWS
AAPPACQKIMTCADPGEIANGHRTASDAGFPVGSHVQYRCLPGYSLEGAAMLTCYSRDTGTPK
WSDRVPKCALKYEPCLNPGVPENGYQTLYKHHYQAGESLRFFCYEGFELIGEVTITCVPGHPS
QWTSQPPLCKVTQTTDPSRQLEGGNLALAILLPLGLVIVLGSGVYIYYTKLQGKSLFGFSGSH
SYSPITVESDFSNPLYEAGDTREYEVSI
```

Important features of the protein:

Signal peptide:

amino acids 1-27

Transmembrane domain:

amino acids 842-864

N-glycosylation sites.

amino acids 176-180, 222-226, 247-251, 332-336, 355-359, 373-377, 473-477, 517-521, 641-645

Tyrosine kinase phosphorylation site.

amino acids 61-69

N-myristoylation sites.

amino acids 2-8, 84-90, 111-117, 114-120, 190-196, 198-204, 235-241, 309-315, 333-339, 351-357, 472-478, 484-490, 528-534, 626-632, 665-671, 775-781, 842-848

Amidation site.

amino acids 384-388

Prokaryotic membrane lipoprotein lipid attachment site.

amino acids 12-23

CUB domain proteins profile.

amino acids 202-218, 376-392, 553-569

FIGURE 113

```
GCCGCGGGCGGAGCTGCCTGCCGGTCCCGCGCCGCGCGTCCGCACTCCTCGGCCCTCGGGCGGTCGATGGGACGG
GGCGCCGCGGAGCAGGAGGCGGCGCCCGTCGGGGTGCTCGGGCCGCGCGGGAGCCCACTGTGGGGCTCGGGCATG
GCGGGCCGCAGGACCTGAGCTCTCCTCAGGGGAGCGGGGAGGCAGCTGCTGGCCGGCGATGGGGACGGAGTGGGG
CCGTCGCCGCCGCCGCCGAGCCGTGAGCGCCGAGCCACCGCCGCCGCTACCTCAGCCCTTCGCGAAGCGCCGGGCA
GCTCGGGAACATGGCCCTGGAGCGGCTCTGCTCGGTCCTCAAAGTGTTGTTAATAACAGTACTGGTAGTGGAAGG
GATTGCCGTGGCCCAAAAAACCCAAGATGGACAAAATATTGGAATCAAGCATATTCCTGCAACCCAGTGTGGCAT
TTGGGTTCGAACCAGCAATGGAGGTCATTTTGCTTCGCCAAATTATCCTGACTCATATCCACCAAACAAGGAGTG
TATCTACATTTTGGAAGCTGCTCCACGTCAAAGAATAGAGTTGACCTTTGATGAACATTATTATATAGAACCATC
ATTTGAGTGTCGGTTTGATCACTTGGAAGTTCGAGATGGGCCATTTGGTTTCTCTCCTCTTATAGATCGTTACTG
TGGCGTGAAAAGCCCTCCATTAATTAGATCAACAGGGAGATTCATGTGGATTAAGTTTAGTTCTGATGAAGAGCT
TGAAGGACTGGGATTTCGAGCAAAATATTCATTTATTCCAGATCCAGACTTTACTTACCTAGGAGGTATTTTAAA
TCCCATTCCAGATTGTCAGTTCGAGCTCTCGGGAGCTGATGGAATAGTGCGCTCTAGTCAGGTAGAACAAGAGGA
GAAAACAAAACCAGGCCAAGCCGTTGATTGCATCTGGACCATTAAAGCCACTCCAAAAGCTAAGATTTATTTGAG
GTTCCTAGATTATCAAATGGAGCACTCAAATGAATGCAAGAGAAACTTCGTTGCAGTCTATGATGGAAGCAGTTC
TATTGAAAACCTGAAGGCCAAGTTTTGCAGCACTGTGGCCAATGATGTAATGCTTAAAACAGGAATTGGAGTGAT
TCGAATGTGGGCAGATGAAGGTAGTCGGCTTAGCAGGTTTCGAATGCTCTTTACTTCCTTTGTGGAGCCTCCCTG
CACAAGCAGCACTTTCTTTTGCCATAGCAACATGTGCATCAATAATTCTTTAGTCTGTAATGGTGTCCAAAATTG
TGCATACCCTTGGGATGAAAATCATTGTAAAGAAAAGAAAAAAGCAGGAGTATTTGAACAAATCACTAAGACTCA
TGGAACAATTATTGGCATTACTTCAGGGATTGTCTTGGTCCTTCTCATTATTTCTATTTTAGTACAAGTGAAACA
GCCTCGAAAAAAGGTCATGGCTTGCAAAACCGCTTTTAATAAAACCGGGTTCCAAGAAGTGTTTGATCCTCCTCA
TTATGAACTGTTTTCACTAAGGGACAAAGAGATTTCTGCAGACCTGGCAGACTTGTCGGAAGAATTGGACAACTA
CCAGAAGATGCGGCGCTCCTCCACCGCCTCCCGCTGCATCCACGACCACCACTGTGGGTCGCAGGCCTCCAGCGT
CAAACAAAGCAGGACCAACCTCAGTTCCATGGAACTTCCTTTCCGAAATGACTTTGCACAACCACAGCCAATGAA
AACATTTAATAGCACCTTCAAGAAAAGTAGTTACACTTTCAAACAGGGACATGAGTGCCCTGAGCAGGCCCTGGA
AGACCGAGTAATGGAGGAGATTCCCTGTGAAATTTATGTCAGGGGGCGAGAAGATTCTGCACAAGCATCCATATC
CATTGACTTCTAATCTTCTGCTAATGGTGATGTGAATTCTTAGGGTGTGTACGTACGCAGCCTCCAGGGCACCAT
ACTGTTTCCAGCAGCCAACCCTTTTCTCCCATCACAACTACGAAGACCTTGATTTACCGTTAACCTATTGTATGG
TGATGTTTTTATTCTCTCAGGCAGTCTATATATGTTAAACCAATCAAGGAACTTACTCTATTCAGTGGAAACAAT
AATCATCTCTATTGCTTGGTGTCATTTATAGGAAGCACTGCCAGTTAAAGAGCATTAGAAGAGGTGGTTGGATGG
AGCCAGGCTCAGGCTGCCTCTTCGTTTTAGCAACAAGAAGACTGCTCTTGACTGATAACAGCTCTGTCAATATTT
TGATGCCACAATAAACTTGATTTTTTTTACATTCCTTTTATTTTTCCTTTCTCTAAATTTAATTTGTTTTATAA
GCCTATCGTTTTACCATTTCATTTTCTTACATAAGTACAAGTGGTTAATGTACCACATACTTCAGTATAGGCATT
TGTTCTTGAGTGTGTCAAAATACAGCTAGTTACTGTGCCAATTAAGACCCAGTTGTATTTCACCCATCTGTTTCT
TCTTGGCTAATCTCTACTTCTGCCTTTTAATTACTGGGCCCTTATTCCTTATTTTCTGTGAGAAATAATAGAT
GATATGATTTATTACCTTTCAATTATATTTTTCTCAGTTATACTAGAAAATTTCATAATCCTGGGATATATGTAC
CATTGTCAGCTATGACTAAAAATTTGAAAAAGATAAAAATTTCTAGCAAGCCTTTGAAGTTTACCAAGTATAGTC
ACATTCAGTGACAGCCCATTCATTCCAGTAAAGAATCATTTCATTCACTTTGGGAGAGGCCTATAATTACATTTA
TTTGCAATGTTTCTCTTCGCTAGATTGTTACATAGCTCCCATTCTGTTGGTTTTGCTTACAGCATATGGTAACCA
AGGTTAGATGCCAGTTAAAATTCCTTAGAAATTGGATGAGCCTTGAGATTGCTTCTTAACTGGGACATGACATTT
TTCTAGCTCTTATCAAGAATAACAACTTCCACTTTTTTTAAACTGCACTTTTGACTTTTTTATGGTATAAAAA
CAATAATTTATAAACATAAAAGCTCATTGTGTTTTTAGACTTTTGATATTATTTGATACTGTACAAACTTTATT
AAATCAAGATGAAAGACCTACAGGACAGATTCCTTTCAGTGTTCACATCAGTGGCTTTGTATGCAAATATGCTGT
GTTGGACCTGGACGCTATAACTTATTGTAAAGACCTTGGAAATGTGGACATAAGCTCTTCTTTCCTTTTGTTAC
TGTATTTAGTTTGTGATAAATTTTTCACTGTGTGATATTTATGCTCTAAATCACTACACAAATCCCATATTAAAA
TATACATTGTACCTGAAAAAAAA
```

FIGURE 114

MALERLCSVLKVLLITVLVVEGIAVAQKTQDGQNIGIKHIPATQCGIWVRTSNGGHFASPNYP
DSYPPNKECIYILEAAPRQRIELTFDEHYYIEPSFECRFDHLEVRDGPFGFSPLIDRYCGVKS
PPLIRSTGRFMWIKFSSDEELEGLGFRAKYSFIPDPDFTYLGGILNPIPDCQFELSGADGIVR
SSQVEQEEKTKPGQAVDCIWTIKATPKAKIYLRFLDYQMEHSNECKRNFVAVYDGSSSIENLK
AKFCSTVANDVMLKTGIGVIRMWADEGSRLSRFRMLFTSFVEPPCTSSTFFCHSNMCINNSLV
CNGVQNCAYPWDENHCKEKKKAGVFEQITKTHGTIIGITSGIVLVLLIISILVQVKQPRKKVM
ACKTAFNKTGFQEVFDPPHYELFSLRDKEISADLADLSEELDNYQKMRRSSTASRCIHDHHCG
SQASSVKQSRTNLSSMELPFRNDFAQPQPMKTFNSTFKKSSYTFKQGHECPEQALEDRVMEEI
PCEIYVRGREDSAQASISIDF

Important features of the protein:
Signal peptide:
amino acids 1-22

Transmembrane domain:
amino acids 348-369

N-glycosylation sites.
amino acids 311-315, 385-389, 453-457, 475-479 cAMP- and cGMP-dependent protein kinase phosphorylation sites.
amino acids 426-430, 479-483

N-myristoylation sites.
amino acids 22-28, 32-38, 54-60, 186-192, 279-285, 318-324, 348-354, 352-358, 441-447

FIGURE 115

```
GGTCTCTGTCCTTGGCTGTGGCTCCTGCGCTCTGGCTGAGCCATGTTCCTTCTCCTCGCCCTC
CTCACTGAGCTTGGAAGACTGCAAGCCCACGAAGGTTCTGAAGGAATATTTCTGCATGTCACA
GTTCCACGGAAGATTAAGTCAAATGACAGTGAAGTTTCAGAGAGGAAGATGATTTACATCATT
ACAATTGATGGACAACCTTACACTCTACATCTCGGAAAACAATCATTCTTACCCCAGAACTTT
TTGGTTTATACATATAATGAAACTGGATCTTTGCATTCTGTGTCTCCATATTTTATGATGCAT
TGCCATTACCAAGGATATGCTGCCGAATTTCCAAATTCATTTGTGACACTCAGTATATGTTCT
GGTCTCAGGGGATTTCTCCAGTTTGAAAATATCAGTTATGGAATTGAACCAGTAGAATCTTCA
GCAAGATTTGAGCATATAATTTATCAAATGAAAATAATGATCCAAATGTATCCATTTTAGCA
GTAAATTACAGTCATATTTGGCAGAAAGACCAGCCCTACAAAGTTCCTTTAAACTCACAGATA
AAAAATCTTTCAAAACTATTACCCCAATATCTGGAAATATACATTATAGTGGAAAAAGCTTTG
ATGTTTACCCAGTTCAAATTGACTGTTATACTGTCTTCCTTGGAATTGTGGTCAAATGAAAAC
CAGATTTCCACCAGTGGGGATGCTGATGATATATTACAAAGATTTTTGGCATGGAAACGGGAC
TATCTCATCCTACGGCCCCATGACATAGCATACTTACTTGTTTACAGGAAACATCCTAAATAT
GTGGGAGCAACATTTCCTGGCACCGTATGCAATAAAAGCTATGATGCAGGTATTGCTATGTAT
CCAGATGCAATAGGTTTGGAGGGATTTTCGGTTATTATAGCTCAACTGCTTGGCCTTAATGTA
GGATTAACATATGATGACATCACTCAGTGTTTCTGTCTGAGAGCTACATGCATCATGAATCAT
GAAGCAGTGAGTGCCAGTGGTAGAAAGATTTTAGCAACTGCAGCATGCACGACTATAGATAT
TTTGTTTCAAAATTTGAGACTAAATGCCTTCAGAAGCTTTCAAATTTGCAACCATTACATCAA
AATCAACCAGTGTGTGGTAATGGGATTTTGGAATCCAATGAAGAATGTGACTGTGGTAATAAA
AATGAATGTCAATTTAAGAAGTGCTGTGATTATAACACATGTAAACTGAAGGGCTCAGTAAAA
TGTGGTTCTGGACCATGTTGTACATCAAAGTGTGAGTTGTCAATAGCAGGCACTCCATGTAGA
AAGAGTATTGATCCAGAGTGTGATTTTACAGAGTACTGCAATGGAACCTCTAGTAATTGTGTT
CCTGACACTTATGCACTGAATGGCCGTTTGTGCAAGTTGGGAACTGCCTATTGCTATAACGGA
CAATGTCAAACTACTGATAACCAGTGTGCCAAGATATTTGGAAAAGGTGCTCAAGGTGCTCCA
TTTGCCTGTTTTAAAGAAGTTAATTCTCTGCATGAAAGATCTGAAAACTGTGGTTTTAAAAAT
TCACAACCATTACCTTGTGAACGGAAGGATGTTCTCTGTGGAAAATTAGCTTGTGTTCAGCCA
CATAAAAATGCTAATAAAAGTGACGCTCAATCTACAGTTTATTCATATATTCAAGACCATGTA
TGTGTATCTATAGCCACTGGTTCCTCCATGAGATCAGATGGAACAGACAATGCCTATGTGGCT
GATGGCACCATGTGTGGTCCAGAAATGTACTGTGTAAATAAACCTGCAGAAAGTTCATTTA
ATGGGATATAACTGTAATGCCACCACAAAATGCAAGGGAAAGGGATATGTAATAATTTTGGT
AATTGTCAATGCTTCCCTGGACATAGACCTCCAGATTGTAAATTCCAGTTTGGTTCCCCAGGG
GGTAGTATTGATGATGGAAATTTTCAGAAATCTGGTGACTTTATACTGAAAAAGGCTACAAT
ACACACTGGAACAACTGGTTTATTCTGAGTTTCTGCATTTTTCTGCCGTTTTTCATAGTTTTC
ACCACTGTGATCTTTAAAGAAATGAAATAAGTAAATCATGTAACAGAGAGAATGCAGAGTAT
AATCGTAATTCATCCGTTGTATCAGAAAGCGATGACGTGGGACATTAATATTGCACAGAACTT
CCATAGCAAATAACCTAAAGGAACGAATGTGCTTTATTTATAACCTTACGTTATCCCCAATGC
ATTGTAAATGTCAAACTTTTGGAAAATAAAGCCTGCGTGCCCTCCC
```

FIGURE 116

MFLLLALLTELGRLQAHEGSEGIFLHVTVPRKIKSNDSEVSERKMIYIITIDGQPYTLHLGKQ
SFLPQNFLVYTYNETGSLHSVSPYFMMHCHYQGYAAEFPNSFVTLSICSGLRGFLQFENISYG
IEPVESSARFEHIIYQMKNNDPNVSILAVNYSHIWQKDQPYKVPLNSQIKNLSKLLPQYLEIY
IIVEKALMFTQFKLTVILSSLELWSNENQISTSGDADDILQRFLAWKRDYLILRPHDIAYLLV
YRKHPKYVGATFPGTVCNKSYDAGIAMYPDAIGLEGFSVIIAQLLGLNVGLTYDDITQCFCLR
ATCIMNHEAVSASGRKIFSNCSMHDYRYFVSKFETKCLQKLSNLQPLHQNQPVCGNGILESNE
ECDCGNKNECQFKKCCDYNTCKLKGSVKCGSGPCCTSKCELSIAGTPCRKSIDPECDFTEYCN
GTSSNCVPDTYALNGRLCKLGTAYCYNGQCQTTDNQCAKIFGKGAQGAPFACFKEVNSLHERS
ENCGFKNSQPLPCERKDVLCGKLACVQPHKNANKSDAQSTVYSYIQDHVCVSIATGSSMRSDG
TDNAYVADGTMCGPEMYCVNKTCRKVHLMGYNCNATTKCKGKGICNNFGNCQCFPGHRPPDCK
FQFGSPGGSIDDGNFQKSGDFYTEKGYNTHWNNWFILSFCIFLPFFIVFTTVIFKRNEISKSC
NRENAEYNRNSSVVSESDDVGH

Important features of the protein:

Signal peptide:

amino acids 1-16

Transmembrane domain:

amino acids 665-684

N-glycosylation sites.

amino acids 36-39, 76-79, 122-125, 149-152, 156-159, 177-180, 270-273, 335-338, 441-444, 537-540, 587-590, 601-604, 703-706

Casein kinase II phosphorylation sites.

amino acids 74-77, 208-211, 221-224, 304-307, 337-340, 346-349, 376-380, 415-418, 499-502, 639-642, 708-711

Tyrosine kinase phosphorylation site.

amino acids 243-249

N-myristoylation sites.

amino acids 53-58, 79-84, 266-271, 298-303, 372-377, 403-408, 408-413, 442-447, 462-467, 469-474, 488-493, 567-572, 610-615, 616-621, 634-639

Amidation site.

amino acids 328-331

FIGURE 117

```
CCCACGCGTCCGCGGACGCGTGGGGCTCAGTGGGCGTCGCGCGAAGGCTAAGGGAGTGTGGCG
GGCGGCTCCGGGAGCCAACATGCCTCGGTATGCGCAGCTGGTCATGGGCCCCGCGGGCAGCGG
GAAGAGCACCTACTGTGCCACCATGGTCCAGCACTGTGAAGCCCTCAACCGGTCTGTCCAAGT
TGTAAACCTGGATCCAGCAGCAGAACACTTCAACTACTCCGTGATGGCTGACATCCGGAACT
GATCGAGGTGGATGATGTAATGGAGGATGATTCTCTGCGATTCGGTCCCAACGGAGGATTGGT
ATTTTGCATGGAGTACTTTGCCAATAATTTTGACTGGCTGGAGAACTGTCTTGGCCATGTAGA
GGACGACTATATCCTTTTTGATTGTCCAGGTCAGATTGAGTTGTACACTCACCTGCCTGTGAT
GAAACATCTGGTCCAGCAGCTCGAGCAGTGGGAGTTCCGAGTCTGTGGAGTTTTTCTTGTTGA
TTCTCAGTTCATGGTGGAGTCATTCAAGTTTATTTCTGGCATCTTGGCAGCCCTGAGTGCCAT
GATCTCTCTAGAAATTCCGCAAGTCAACATCATGACAAAAATGGATCTGCTGAGTAAAAAAGC
AAAAAAGGAAATTGAGAAATTTTTAGATCCAGACATGTATTCTTTATTAGAAGATTCTACAAG
TGACTTAAGAAGCAAAAAATTCAAGAAACTGACTAAAGCTATATGTGGACTGATTGATGACTA
CAGCATGGTTCGATTTTTACCTTACGATCAGTCAGATGAAGAAAGCATGAACATTGTATTGCA
GCATATTGATTTTGCCATTCAATATGGAGAAGACCTAGAATTTAAAGAACCAAAGGAACGTGA
AGATGAGTCTTCCTCTATGTTTGACGAATATTTTCAAGAATGCCAGGATGAATGAAGAGTTTA
CTAAAAGTAACCATCTAAAGAGCTTGTGGCCAAACCAGCAGAACATTCTTCTCTTCAAAGGAT
GCAATAGTAGAAAGCTACTTATTTAATGAAAAAAGTAAAACTTCGTTCTTTATCAGCCTCA
TGCCTGAATCAAATTTTTAATTATTCTGAAACTGCTGCTGTTTAAAGTGGAATCTTTTAGTAT
TATAACAGCATCACTTTAGATTTTGTAAGTCAAAATTGAAATGAATGCACATAGATTTATATA
TAAATTAGCACCTGAGCTAAGGTTAAGGCCGGTCTAAACTTATTTTCACTTTTTGTATTATTT
TTGAGATGCAGGAATTACTGTAACAAAATATGTATGTCCGAAGGGAAAAAGCTGCAAGGATAT
ATATAAGACCACTGCTTATCTGTATCTTCCCATTTTCCTATATTGAAAATGTATATTATTTAT
ATAACTTAAAAAGTAAAAATAACTATGTTTTGAGAT
```

FIGURE 118

MPRYAQLVMGPAGSGKSTYCATMVQHCEALNRSVQVVNLDPAAEHFNYSVMADIRELIEVDDV
MEDDSLRFGPNGGLVFCMEYFANNFDWLENCLGHVEDDYILFDCPGQIELYTHLPVMKHLVQQ
LEQWEFRVCGVFLVDSQFMVESFKFISGILAALSAMISLEIPQVNIMTKMDLLSKKAKKEIEK
FLDPDMYSLLEDSTSDLRSKKFKKLTKAICGLIDDYSMVRFLPYDQSDEESMNIVLQHIDFAI
QYGEDLEFKEPKEREDESSSMFDEYFQECQDE

Important features of the protein:

Signal peptide:

amino acids 1-29

Transmembrane domain:

amino acids 151-170

N-glycosylation sites.

amino acids 31-35, 47-51 cAMP- and cGMP-dependent protein kinase phosphorylation site.

amino acids 212-216

Tyrosine kinase phosphorylation site.

amino acids 189-197

N-myristoylation sites.

amino acids 13-19, 76-82, 154-160

ATP/GTP-binding site motif A (P-loop).

amino acids 10-18

FIGURE 119

```
GGGCGCTGGGAGACACCGGACGCCCGCTCGGCTGCGCTGCGGCTCAGGCCCCGCTCGGGCCC
GACCCGCTCGGTCACCGCCGGCTCGGGCGCGCACCTGCCGGCTGCGGCCCCAGGGCCATGCGG
AGGCCCACGAGGAGGCCGGCGGCCACGCGCATCCCGTAGCCCAGGTGGCCCAGGTCTGCACCG
CGGCGGCCTCGGCGCCATGGAGCCCCGTATTCGCTGACGGCGCACTACGATGAGTTCAAGA
GGTCAAGTACGTGAGCCGCTGCGGCGCGGGGGGCGCGCGCGGGGCCTCCCTGCCCCCGGCTT
CCCGTTGGGCGCTGCGCGCAGCGTCACCGGGGCCCGGTCCGGGCTGCCGCGCTGGAACCGGCG
CGAGGTGTGCCTGCTGTCGGGGCTGGTGTTCGCCGCCGGCCTCTGCGCCATTCTGGCGGCTAT
GCTGGCCCTCAAGTACCTGGGCCCGGTCGCGGCCGGCGGCGGCGCCTGTCCCGAGGGCTGCCC
TGAGCGCAAGGCCTTCGCGCGCGCCGCTCGCTTCCTGGCCGCCAACCTGGACGCCAGCATCGA
CCCATGCCAGGACTTCTACTCGTTCGCCTGCGGCGGTTGGCTGCGGCGCCACGCCATCCCCGA
CGACAAGCTCACCTATGGCACCATCGCGGCCATCGGCGAGCAAAACGAGGAGCGCCTACGGCG
CCTGCTGGCGCGGCCCGGGGGTGGGCCTGGCGGCGCGGCCCAGCGCAAGGTGCGCGCCTTCTT
CCGCTCGTGCCTCGACATGCGCGAGATCGAGCGACTGGGCCCGCGACCCATGCTAGAGGTCAT
CGAGGACTGCGGGGGCTGGGACCTGGGCGGCGCGGAGGAGCGTCCGGGGGTCGCGGCGCGATG
GGACCTCAACCGGCTGCTGTACAAGGCGCAGGGCGTGTACAGCGCCGCCGCGCTCTTCTCGCT
CACGGTCAGCCTGGACGACAGGAACTCCTCGCGCTACGTCATCCGCATTGACCAGGATGGGCT
CACCCTGCCAGAGAGGACCCTGTACCTCGCTCAGGATGAGGACAGTGAGAAGATCCTGGCAGC
ATACAGGGTGTTCATGGAGCGAGTGCTCAGCCTCCTGGGTGCAGACGCTGTGGAACAGAAGGC
CCAAGAGATCCTGCAAGTGGAGCAGCAGCTGGCCAACATCACTGTGTCAGAGTATGACGACCT
ACGGCGAGATGTCAGCTCCATGTACAACAAGGTGACGCTGGGGCAGCTGCAGAAGATCACCCC
CCACTTGCGGTGGAAGTGGCTGCTAGACCAGATCTTCCAGGAGGACTTCTCAGAGGAAGAGGA
GGTGGTGCTGCTGGCGACAGACTACATGCAGCAGGTGTCGCAGCTCATCCGCTCCACACCCA
CCGGGTCCTGCACAACTACCTGGTGTGGCGCGTGGTGGTGGTCCTGAGTGAACACCTGTCCCC
GCCATTCCGTGAGGCACTGCACGAGCTGGCACAGGAGATGGAGGGCAGCGACAAGCCACAGGA
GCTGGCCCGGGTCTGCTTGGGCCAGGCCAATCGCCACTTTGGCATGGCGCTTGGCGCCCTCTT
TGTACATGAGCACTTCTCAGCCGCCAGCAAAGCCAAGGTGCAGCAGCTAGTGGAAGACATCAA
GTACATCCTGGGCCAGCGCCTGGAGGAGCTGGACTGGATGGACGCCGAGACCAGGGCTGCTGC
TCGGGCCAAGCTCCAGTACATGATGGTGATGGTCGGCTACCCGGACTTCCTGCTGAAACCCGA
TGCTGTGGACAAGGAGTATGAGTTTGAGGTCCATGAGAAGACCTACTTCAAGAACATCTTGAA
CAGCATCCCCTTCAGCATCCAGCTCTCAGTTAAGAAGATTCGGCAGGAGGTGGACAAGTCCAC
GTGGCTGCTCCCCCACAGGCGCTCAATGCCTACTATCTACCCAACAAGAACCAGATGGTGTT
CCCCGCGGGCATCCTGCAGCCCACCCTGTACGACCCTGACTTCCCACAGTCTCTCAACTACGG
GGGCATCGGCACCATCATTGGACATGAGCTGACCCACGGCTACGACGACTGGGGGGGCCAGTA
TGACCGCTCAGGGAACCTGCTGCACTGGTGGACGGAGGCCTCCTACAGCCGCTTCCTGCGAAA
GGCTGAGTGCATCGTCCGTCTCTATGACAACTTCACTGTCTACAACCAGCGGGTGAACGGGAA
ACACACGCTTGGGGAGAACATCGCAGATATGGGCGTCCTCAAGCTGGCCTACCACGCCTATCA
GAAGTGGGTGCGGGAGCACGGCCCAGAGCACCCACTTCCCCGGCTCAAGTACACACATGACCA
GCTCTTCTTCATTGCCTTTGCCCAGAACTGGTGCATCAAGCGGCGGTCGCAGTCCATCTACCT
GCAGGTGCTGACTGACAAGCATGCCCCTGAGCACTACAGGGTGCTGGGCAGTGTGTCCCAGTT
TGAGGAGTTTGGCCGGGCTTTCCACTGTCCCAAGGACTCACCCATGAACCCTGCCCACAAGTG
TTCCGTGTGGTGAGCCTGGCTGCCCGCCTGCACGCCCCACTGCCCCGCACGAATCACCTCC
TGCTGGCTACCGGGGCAGGCATGCACCCGGTGCCAGCCCGCTCTGGGCACCACCTGCCTTCC
AGCCCCTCCAGGACCCGGTCCCCCTGCTGCCCCTCACTTCAGGAGGGGCCTGGAGCAGGGTGA
GGCTGGACTTTGGGGGGCTGTGAGGGAAATATACTGGGGTCCCCAGATTCTGCTCTAAGGGGG
CCAGACCCTCTGCCAGGCTGGATTGTACGGGCCCCACCTTCGCTGTGTTCTTGCTGCAAAGTC
TGGTCAATAAATCACTGCACTGTTAAAAAAAA
```

FIGURE 120

```
MEPPYSLTAHYDEFQEVKYVSRCGAGGARGASLPPGFPLGAARSVTGARSGLPRWNRREVCLL
SGLVFAAGLCAILAAMLALKYLGPVAAGGGACPEGCPERKAFARAARFLAANLDASIDPCQDF
YSFACGGWLRRHAIPDDKLTYGTIAAIGEQNEERLRRLLARPGGGPGGAAQRKVRAFFRSCLD
MREIERLGPRPMLEVIEDCGGWDLGGAEERPGVAARWDLNRLLYKAQGVYSAAALFSLTVSLD
DRNSSRYVIRIDQDGLTLPERTLYLAQDEDSEKILAAYRVFMERVLSLLGADAVEQKAQEILQ
VEQQLANITVSEYDDLRRDVSSMYNKVTLGQLQKITPHLRWKWLLDQIFQEDFSEEEEVVLLA
TDYMQQVSQLIRSTPHRVLHNYLVWRVVVVLSEHLSPPFREALHELAQEMEGSDKPQELARVC
LGQANRHFGMALGALFVHEHFSAASKAKVQQLVEDIKYILGQRLEELDWMDAETRAAARAKLQ
YMMVMVGYPDFLLKPDAVDKEYEFEVHEKTYFKNILNSIPFSIQLSVKKIRQEVDKSTWLLPP
QALNAYYLPNKNQMVFPAGILQPTLYDPDFPQSLNYGGIGTIIGHELTHGYDDWGGQYDRSGN
LLHWWTEASYSRFLRKAECIVRLYDNFTVYNQRVNGKHTLGENIADMGVLKLAYHAYQKWVRE
HGPEHPLPRLKYTHDQLFFIAFAQNWCIKRRSQSIYLQVLTDKHAPEHYRVLGSVSQFEEFGR
AFHCPKDSPMNPAHKCSVW
```

Important features of the protein:

Transmembrane domain:

amino acids 64-88

N-glycosylation sites.

amino acids 255-259, 322-326, 656-660 cAMP- and cGMP-dependent protein kinase phosphorylation site.

amino acids 722-726

N-myristoylation site.

amino acids 24-30, 26-32, 27-33, 40-46, 47-53, 65-71, 148-154, 169-175, 170-176, 237-243, 450-456, 604-610, 607-613

Prokaryotic membrane lipoprotein lipid attachment site.

amino acids 85-96

Prenyl group binding site.

amino acids 772-777

Neutral zinc metallopeptidases, zinc-binding region signature.

amino acids 609-619

Neutral zinc metallopeptidases, zinc-binding region proteins.

amino acids 609-619

FIGURE 121

CGGACTGCCCGGACCGCGCG<u>ATG</u>GAGTCGACCGGCAGCGTCGGGGAGGCCCCGGGCGGACCCC
GGGTGCTGGTGGTGGGCGGCGGCATCGCGGGGCTGGGCGCGGCGCAGAGGCTCTGCGGCCACT
CCGCCTTCCCGCACCTGCGGGTCCTGGAGGCCACGGCCCGCGCCGGGGCCGCATCCGCTCGG
AGCGCTGCTTCGGTGGCGTGGTGGAGGTGGGCGCGCACTGGATCCATGGGCCCTCCCGGGGTA
ACCCCGTCTTCCAGCTGGCTGCTGAGTACGGGCTGCTGGGGGAGAAGGAGCTGTCCCAGGAGA
ACCAGCTGGTGGAGACCGGGGGTCACGTGGGCCTGCCCTCCGTGAGCTACGCCAGCTCCGGGG
CCAGCGTGAGCCTCCAGCTGGTGGCGGAGATGGCGACTCTGTTCTACGGCCTGATAGACCAGA
CCCGGGAGTTCCTGCACGCTGCAGAGACCCCGGTGCCCAGCGTCGGGGAGTACCTCAAGAAGG
AGATTGGCCAGCACGTGGCCGGCTGGACAGAGGATGAGGAGACCAGGAAGCTGAAGCTGGCCG
TCCTGAACTCCTTCTTCAACCTGGAATGCTGTGTGAGCGGCACCCACAGCATGGACCTGGTGG
CCCTGGCACCCTTTGGGGAGTATACCGTGCTGCCGGGGCTGGACTGCACCTTTTCTAAGGGCT
ATCAAGGACTCACAAACTGCATGATGGCCGCCCTGCCGGAGGACACTGTAGTTTTGAGAAGC
CTGTGAAGACCATCCACTGGAACGGGTCCTTCCAGGAGGCAGCCTTTCCCGGGGAGACCTTTC
CAGTGTCGGTAGAGTGTGAGGATGGAGACCGGTTCCCGGCGCACCATGTCATCGTCACCGTGC
CCTTAGGTTTTCTTAGGGAACATTTGGACACCTTCTTTGACCCTCCCCTGCCGGCTGAGAAGG
CAGAAGCAATCAGGAAGATAGGCTTTGGGACCAACAACAAAATCTTCCTGGAGTTTGAGGAGC
CCTTCTGGGAGCCAGACTGCCAGCTGATCCAGCTGGTGTGGGAGGACACGTCGCCCCTGGAGG
ATGCTGCCCCTGAGCTACAGGACGCCTGGTTCCGGAAGCTCATTGGCTTTGTGGTCCTGCCTG
CCTTTGCGTCTGTCCACGTTCTCTGTGGGTTCATTGCCGGACTTGAGTCTGAGTTCATGGAGA
CTCTGTCGGATGAAGAAGTACTTCTGTGTCTCACCCAAGTGCTCCGGAGAGTGACAGGAAACC
CACGGCTCCCCGCGCCCAAGAGCGTCCTGCGGTCTCGCTGGCACAGCGCCCCGTACACTAGGG
GGTCCTACAGCTACGTGGCCGTGGGCAGTACTGGGGGCGACCTGGACCTGCTGGCTCAGCCCC
TCCCTGCAGACGGCGCCGGCGCCCAGCTCCAGATCCTGTTTGCGGGGGAAGCCACACATCGCA
CGTTTTACTCCACGACGCACGGGGCTCTGCTGTCGGGATGGAGGGAGGCCGACCGCCTCCTCA
GTCTGTGGGCCCCGCAGGTGCAGCAGCCCAGGCCGAGGCTC<u>TAG</u>CTGGGCCCAGCCTACTCTG
TTCCACCCGTGTCGGGGGTAGGCTGGGACCGTCATTTCTTCTGACAGATTTCAGTCTGGCTTG
AAATTTGGGGATGTTAATGAGGGTCCTCTGGTTTTTGGTAACCAGGGCCACCTTCTCAGTTCT
TGTGTCTGTTATTGGAGTCTGGCCAGGGTTGACTTGAGCTGAGACACCAGATGCTCACGGAGA
TGCTGGACACATAAAGCAAGTTACAGCCACAAAAAAAAAAAA

FIGURE 122

MESTGSVGEAPGGPRVLVVGGGIAGLGAAQRLCGHSAFPHLRVLEATARAGGRIRSERCFGGV
VEVGAHWIHGPSRGNPVFQLAAEYGLLGEKELSQENQLVETGGHVGLPSVSYASSGASVSLQL
VAEMATLFYGLIDQTREFLHAAETPVPSVGEYLKKEIGQHVAGWTEDEETRKLKLAVLNSFFN
LECCVSGTHSMDLVALAPFGEYTVLPGLDCTFSKGYQGLTNCMMAALPEDTVVFEKPVKTIHW
NGSFQEAAFPGETFPVSVECEDGDRFPAHHVIVTVPLGFLREHLDTFFDPPLPAEKAEAIRKI
GFGTNNKIFLEFEEPFWEPDCQLIQLVWEDTSPLEDAAPELQDAWFRKLIGFVVLPAFASVHV
LCGFIAGLESEFMETLSDEEVLLCLTQVLRRVTGNPRLPAPKSVLRSRWHSAPYTRGSYSYVA
VGSTGGDLDLLAQPLPADGAGAQLQILFAGEATHRTFYSTTHGALLSGWREADRLLSLWAPQV
QQPRPRL

Signal peptide:
amino acids 1-28

Transmembrane domain:
amino acids 364-385

N-glycosylation site.
amino acids 253-257 cAMP- and cGMP-dependent protein kinase phosphorylation site.
amino acids 408-412

N-myristoylation sites.
amino acids 20-26, 21-27, 25-31, 105-111, 119-125, 164-170, 216-222, 227-233, 443-449, 484-490

Aminooxidase Flavin containing amine oxidase:
amino acids 23-497

FIGURE 123

```
CGGACGCGTGGGGGAAGATGGATAAATAATTCTGTCACACGTGCCCTGGCCTCTGGAGCTCAGCTGCCAGTCCAC
GTCTAGGGAATCTTAGCATCTGGGACCAAGACACTTTACAGCAATCATCACCCTTTGCAGAGGAGGTGAGCTCAC
CAGGACTCATCTGCCATTTCAGACCTTTTGCTGCTACCTGCCAGGTGGCCCCCACTGCTGACGAGAGATGGTGGA
TCTCTCAGTCTCCCCGGACTCCTTGAAGCCAGTATCGCTGACCAGCAGTCTTGTCTTCCTCATGCACCTCCTCCT
CCTTCAGCCTGGGGAGCCGAGCTCAGAGGTCAAGGTGCTAGGCCCTGAGTATCCCATCCTGGCCCTCGTCGGGGA
GGAGGTGGAGTTCCCGTGCCACCTATGGCCACAGCTGGATGCCCAGCAAATGGAGATCCGCTGGTTCCGGAGTCA
GACCTTCAATGTGGTACACCTGTACCAGGAGCAGCAGGAGCTCCCTGGCAGGCAGATGCCGGCGTTCCGGAACAG
GACCAAGTTGGTCAAGGACGACATCGCCTATGGCAGCGTGGTCCTGCAGCTTCACAGCATCATCCCCTCTGACAA
GGGCACATATGGCTGCCGCTTCCACTCCGACAACTTCTCTGGCGAAGCTCTCTGGGAACTGGAGGTAGCAGGGCT
GGGCTCAGACCCTCACCTCTCCCTTGAGGGCTTCAAGGAAGGAGGCATTCAGCTGAGGCTCAGATCCAGTGGCTG
GTACCCCAAGCCTAAGGTTCAGTGGAGAGACCACCAGGGACAGTGCCTGCCTCCAGAGTTTGAAGCCATCGTCTG
GGATGCCCAGGACCTGTTCAGTCTGGAAACATCTGTGGTTGTCCGAGCGGGAGCCCTCAGCAATGTGTCCGTCTC
CATCCAGAATCTCCTCTTGAGCCAGAAGAAAGAGTTGGTGGTCCAGATAGCAGACGTGTTCGTACCCGGAGCCTC
TGCGTGGAAGAGCGCGTTCGTCGCGACCCTGCCGCTGCTGTTGGTCCTCGCGGCGCTGGCGCTGGGCGTCCTCCG
GAAGCAGCGGAGAAGCCGAGAAAAGCTGAGGAAGCAGGCGGAGAAGAGACAAGAGAAACTCACTGCAGAGCTGGA
AAAGCTTCAGACAGAGCTTGACTGGAGACGGGCTGAAGGCCAGGCTGAGTGGAGAGCAGCCCAAAAATATGCAGT
GGATGTGACGCTGGACCCGGCCTCGGCGCACCCCAGCCTGGAGGTGTCGGAGGATGGCAAGAGCGTGTCTTCCCG
CGGGGCGCCGCCAGGCCCGGCGCCTGGCCACCCGCAGCGGTTCTCGGAGCAGACGTGCGCGCTGAGCCTGGAGCG
GTTCTCCGCCGGCCGCCACTACTGGGAGGTGCACGTGGGCCGCCGCAGCCGCTGGTTCCTGGGCGCCTGCCTGGC
CGCGGTGCCGCGCGCGGGGCCTGCCGCGCCTGAGCCCTGCGGCCGGCTACTGGGTGCTGGGGCTGTGGAACGGCTG
CGAGTACTTCGTCCTGGCCCCGCACCGCGTCGCGGCTCACCCTGCGCGTGCCCCCGCGGCGCCTGGGCGTCTTCCT
GGACTACGAGGCCGGAGAGCTGTCCTTCTTCAACGTGTCCGACGGCTCCCACATCTTCACCTTCCACGACACCTT
CTCGGGCGCGCTCTGTGCGTACTTCAGGCCCAGGGCCCACGACGGCGGCGAACATCCGGATCCCCTGACCATCTG
CCCGCTGCCGGTTAGAGGGACGGGCGTCCCCGAAGAGAACGACAGTGACACCTGGCTACAGCCCTATGAGCCCGC
GGACCCCGCCCTGGACTGGTGGTGAGGCGCCCTCGTGGCCGCGGGACTGGCCCCGGGGGCCCCCTGGATCCCAG
GCCAGCGCTTTGCTCTCCTGCTCCGTCTGAAGGGAGCAGGTGCACCAGCCAAAATGTCAGCGAGGGGACAAAGA
GAGGGACCTTTGCCTACGTAGATGTGTATGTGTAGTGCGATTTTCTTCAAGGAAAGGAGACAAGTCCAAAGCTCG
TTTGTGGATTGTGGGACTGAGCGAAGGAGTACAAATATATCCACGTCGCTCAGAGCTGGGGTGCTCACGGTGGGC
GGTGGGCAAGAAGCCAGCATGGAAGAAAGAAGGGAGAAAACTTTGGTGACTGCCTTAGAGGGATCAGTTAATTTG
TATAGTTTTATATTTTTGTATATGTTTGCTAGCTCTAAAAAGGTCGAGATGCAATAACACTTCGTAAGCAACGA
GTTCACCTAAGTAAGGCTCAGATCCTAGTTTTAAAAACCATTTCCCATTAAAATGAAGTTGGAGGAACAGCTGCT
TCTGAGCCGGGGCAAAAATTTCAAGGTGAGCCTGGAGCATTGTGTGTGGTGAAGTAAAATAAAGGCTCAAAACGT
GACGGCAACCCGGCAAAAGGGTAGGGAGCCAGGCCGAAGGGGCCTCACTGACCAATTGTGGGACAATTTGAACAT
CAGGATGAATAATGACAGGAGAGATTATAACACACTGAATAAAAACATAATCCATGAGTTCATGCTGATACTCAA
ATTTCTTTTTAAAAGGAGAAACAGGAAGGTTTCTTTTGGAGGTGAAATCTAATTATTGGTGAGAGTCTTGGAGA
ACAGGCTGTTTCCAGTCTCAAAGCAGTAACCTTATACACTACTTATAAGTTTGAAAGGGGAAAGGTTACCTTTAC
AATGGAGACATCTACCAGATCATCCAAGTGATTAAATTTAACATCATCAATGATGGGACCAAGGACATTATTAGT
TTGACAACTGGGGAAAGAAGTGTTCTTCACCCCCTACCCCCAAGACATTCTCTCTGTCGGCCAGGCTGGAGTGCA
GCCTCAACCTCCTGGGCCCAAGTGATCCTCCCACCTCAGCACACAACACCATGCCCAATTTTAAGTGCGTTATAG
AGACGGGGTCTCACTTTGTTACCCAGGCTGGTCTCAAACTCCTGCGCTCAAGCAATCCTCCCACCTGGGCCTCC
CAAATGCTGGGTGTACAGGCATGAGCCGCTGTGCCTGGCTTCATTTTCAGAGTGAGACATTTGTACTGTGGCTA
TGTAGGAGAACATTCTTGTTCTTAGCAAACATACTGAAGTTTTTAGATATTAATTACCACAGTGTCTGCCACTGA
ATTTCCAGTGACTAAGTGGAAAAATATAAAACATATGAATATAAAGAAAGAAAGAGACAAGTCAAATGTAGTAAA
ATGACAACACTTGGTGACTCTAGGTGACTGGTCGACAGATGTTCATTGTACTATCAATGTGGCTTTGCTGTGGGT
TTGAAATTTTGCAAACTAAGAGTTGGGTGGCGGGAGAAGGATACACCAAAAAACTAAGTGATTATCTTTGGATG
GGAAAATGTTTGGTAATTGCATTCTTAAAATGTCTTCTTTGTATTTTTTAATGTTCAATAATGTATATGTATCAG
TTCTGTAATAAAGGGGAAAACACTTTTCA
```

FIGURE 124

MVDLSVSPDSLKPVSLTSSLVFLMHLLLLQPGEPSSEVKVLGPEYPILALVGEEVEFPCHLWP
QLDAQQMEIRWFRSQTFNVVHLYQEQQELPGRQMPAFRNRTKLVKDDIAYGSVVLQLHSIIPS
DKGTYGCRFHSDNFSGEALWELEVAGLGSDPHLSLEGFKEGGIQLRLRSSGWYPKPKVQWRDH
QGQCLPPEFEAIVWDAQDLFSLETSVVVRAGALSNVSVSIQNLLLSQKKELVVQIADVFVPGA
SAWKSAFVATLPLLLVLAALALGVLRKQRRSREKLRKQAEKRQEKLTAELEKLQTELDWRRAE
GQAEWRAAQKYAVDVTLDPASAHPSLEVSEDGKSVSSRGAPPGPAPGHPQRFSEQTCALSLER
FSAGRHYWEVHVGRRSRWFLGACLAAVPRAGPARLSPAAGYWVLGLWNGCEYFVLAPHRVALT
LRVPPRRLGVFLDYEAGELSFFNVSDGSHIFTFHDTFSGALCAYFRPRAHDGGEHPDPLTICP
LPVRGTGVPEENDSDTWLQPYEPADPALDWW

Important features of the protein:

Signal peptide:

amino acids 1-34

Transmembrane domain:

amino acids 247-272

N-glycosylation sites.

amino acids 102-106, 139-143, 224-228, 464-468, 516-520

Tyrosine kinase phosphorylation site.

amino acids 105-114

N-myristoylation sites.

amino acids 129-135, 220-226, 399-405, 423-429, 480-486

Amidation site.

amino acids 390-394

FIGURE 125

```
TATAGTCCCAGCTACTCATGGGGCTGATGCAGGTTGAGGCAGGAGGTTCATGAGCCCAGGAGGTTGGAGCTGTAA
TGAGCTAGGATTCTGCCTCTGCACTCCTAGCTGGATGACAGAGCAAGACCCTGTCTCAAAAAAGAAAAAAAAAAA
AAAAAGAATGCATGAACCAGACATGACAGTTCCTGGCCTCAAAGATCTTCCAAAGGAAATGATTTTTTTTAACC
ACCAATGCTGCAGGAAAAAGCAACATATTTAAGTTATCCAATAACACCTATCCAATAATTGTAAATCATTATCAT
GACATGGTAGAGTTGTTTATATTTCTTTTCCTTTTAGGTGAAACACCATTCAAAGTCGTAGTCAAATCTCTTTCA
CCTAAAGAGTTGGTCCGGATACATGTCCCTAAACCTTTGGACAGGAATGATGGAACATTTTTGATGAGATATAGG
ATGTATGAAACTGTCGATGAAGGCCTGAAGATAGAGGTCCTTTATGGTGATGAACATGTGGCTCAGTCTCCCTAT
ATTTTGAAAGGACCAGTGTACCATGAGTACTGTGAGTGTCCGGAAGATCCTCAGGCCTGGCAGAAGACTCTTTCT
TGTCCAACCAAGGAACCACAGATTGCAAAAGATTTTGCTTCCTTTCCCAGCATCAATCTCCAGCAAATGCTAAAA
GAAGTCCCCAAAAGGTTTGGGGATGAGAGAGGTGCCATTGTTCATTACACGATTCTCAATAACCATGTTTACCGG
AGATCTTTAGGGAAATACACAGACTTCAAGATGTTCTCTGATGAGATTTTGTTATCATTGACAAGAAAGGTCCTT
CTCCCAGATTTAGAATTTTATGTTAATCTTGGAGATTGGCCCTTGGAGCATCGAAAAGTCAATGGAACCCCTAGC
CCCATACCTATCATTTCATGGTGTGGCTCTCTGGATTCAAGAGATGTTGTCCTTCCAACGTATGACATCACCCAC
TCCATGCTTGAAGCCATGCGGGGTGTTACAAATGATCTCCTCTCTATTCAGGGAAATACAGGGCCTTCCTGGATC
AATAAAACAGAGAGAGCTTTCTTCAGAGGTAGAGACAGCCGAGAGGAGAGGCTCCAGTTGGTACAGCTGTCCAAA
GAAAATCCTCAGCTACTAGATGCAGGAATTACAGGATATTTCTTTTTCCAAGAGAAAGAAAAGGAGCTTGGAAAA
GCCAAGTTGATGGGTTTCTTTGATTTCTTTAAGTACAAGTATCAAGTAAATGTGGATGGGACCGTGGCTGCTTAC
AGATATCCATATCTCATGCTGGGCGACAGTCTGGTTTTAAAGCAGGACTCGCCATATTATGAACATTTCTACATG
GCACTAGAACCTTGGAAGCATTATGTTCCAATTAAAAGAAATCTGAGTGATTTATTAGAGAAAGTTAAATGGGCT
AAGGAAAATGATGAAGAAGCCAAGAAGATTGCAAAAGAAGGACAGTTGATGGCTAGGGACCTACTACAGCCACAC
AGGCTTTACTGCTACTATTACCAAGTACTGCAGAAATATGCCGAGCGCCAGTCCAGCAAACCCGAAGTACGTGAT
GGAATGGAACTTGTTCCTCAGCCAGAAGATAGCACAGCCATCTGCCAGTGCCACAGGAAAAAGCCTTCAAGAGAA
GAACTTTGAGTCAGCCCAGAATCACACTCCTGTGTATCCCGGCTACACTTTAAGGAAAGATTGAATCTAAGCTGT
GAAGGACAGTATAGAAGACTGCACCAAGTGGACTAGTTCTCCCGGTGGCTTTATATATGTAGATGGATATAGCAG
TACTGGTTGAGTATCCCTCATCTGAAATGCTTAGGACCAGGAGTGTTTCAGGCTTCAGATTTTTTAAGATTTGGG
AATATTTGCATGTACATAATGAGGTATCTTGGGGATGAGATCCAAGTCTAAACACAAAATTCATTTATATTTTAT
ATATACCTTGTTCACATACCCTGAAGGTAATTTTATATAATATTTTTAATAATTTGTGCATGAAACAAAGTTTGT
ATACATTGAACTGTCAGAAAGCAAAGGTGTCACTATCTTAGCGACCCAAGTGGTGGTGTCAGCACTCAAAAAGTT
TTGGATTTTGGGGTATTTCAGATTTTAGATTTTTGTATGAGGAATGTTCAACCTGTATTTGAACAAGCATTACCA
AATATCATTGAATATTAATATCTTTTGCGTAAAAACTGCTATTATCAGCATCATAGTTTCTCTAAAAAGAAAACT
TGGGGATCATAGCCGATAGAGAGACTTGCTAAAATATAAATCAGCCTCTGCAAAACACTGAAAACCTCTACAACAATCT
TCACATATTTTATTGGTTTATTTCTATCCCCTGTTCACTTTTTCTCTTCCACTTCCAATTATGAAGAGAAAATAT
TTGTTCAGGGTTGTCCCCCCGCCCCCGTCACTGCATAATTTCTCCTCTTACAAGCTGCTTTTGGCTTTCATTAA
TAACAGCTTCCTTTTAGAAGGTCTGATAAGGATATTTAAGGAAGAAGAGAATGACTCTGTTATTAAAGGTGGCAT
GGAGACTGTGGAGGGAATATTTTTTAAAGCACTACTCATATCCTTTAAACTAAATTTTGCCAAAGCCCGAGACAA
CATTAAGGAGAAATTGTACCTTAAGTTAGTAATTCCAAATCTATCTGAGTTGTATACCCATCAAAGACAATACAG
TTATTAACATAGATGAAGGTATGCTATAGGCATCATTCATTATCTCTATATTGAATAGGTGAAAGATAACTGTAG
TCAGGTGAAAGGCATTCATCATTTTTAAGCTGAAAAGGGGATCCTTGAAACACTGAAAACCTCTACAACAATCT
TCAGGAAGCCTGCTATCTTGGGATTCACTAATAATAGGCCAAGAACAAAGGCAAGCATCCATTCCTCACTCCACC
ACTTTTCTATTTCAGTGGGTGTCATTGCTACGATGAAGACTTTGGAAATTTCCTTTCTCTTTTAGGACAGGGTCA
GGATTTAGGACTCATAGCCTGAAAGCTCATTACATACTCCTTGTAACCATCAGTCCAAGGTTCAGTTCACTAAAG
TGCATGTTCTAAAACAAGAGCTATCCTCATTCCAAATTTTAAAATATGTACTCTGGCCGGTTGCAGTGGCTCACG
CCTGTAATCCCAGCACTTTGGCAGGCCGAGATGGGCGGATCTTTTGAGGTCAGGAGTTTGAGACCAGCCTGGCCA
ACATGGTGAAACCCCGTCTCTACTAAAAATACAAAAATTAGCCAGGCATGGTGGCATTTGCCTGTAATCCCAGCT
ACTCGGGAGGCTGAGGCAGGAGAATCACTTGAACCTGGGAGGCAGAGGTTGCAGTGAGCTGAGATTACACCACTG
CACTCCAGCCTGGGTGACAGAGTGAGACTCCATCTCAAAAACTGAAAATAAAAATAAAAATATGTATTCTCCTAA
CTGAAATATTTACTTAATCTGGAAAACAATGTAACTATTTTTAAAGTGGTTACATCTATTCTTGCTGAAGAACAA
TAAACAGAATTTTTTGACTAAGCATAACCAAATTTCAGAACAGTCTAATCAATGCCAAGTATCCAAGGCAAACTC
TAATACCCATCCATTGTGCAAAACCACAAGCACGCAAGTATTAAATAAGAGCAAGCTGTCCTGAGCCCATACCTA
ATGAATTTGTGTCTTAAATATTGTACATTGTGTTTGAGGCTTGTCAAAACTGGGATTATGGCAAGAAAGGTTGCC
TAACTCATACCTTTCTGCCTCAAATTCCAGGTGCTAAAGGCTAATGGCATTTTAAACATCTTACATTTTTAAAAA
TTTATATTGCCTCTGCCAAACAGGCCTAATAGTTAAAAGCAAGTTGAGACAAACCAGGCAGATTCAGTGTGTGGA
ACAGGAAGGATGTGCTTTAAAAAAAGGTGGAATCCCTCAAAAAATTCTATAGGGAGACAGCAGCCTTAATCTACA
TAATTCTTCATCTCGCCAATTCAGCCGCAGCCTTTAAAGAGTTAGTGTTAATGGCTTTCTGGTTTGAAAACAAAA
ATGCATCTATGTGGTTGAAAGTTTGGGAGGAGATTCACCAATATCTGAGGAGAAGATGGAGTGAAGGGAATTCTT
ACTTTTTGCTTTATACCTTTCTATAATATTTAGATTTTTTTTACTGTAAGTATGGATCAAATTGCAAAATAAAG
AAAAATGCCAACCTTAGAAAAGACAATAAATGCACAAAAGATATAAACAGGAACAGCAAATATTTATATTTTTC
CATTTTGCTCTTTTTAAATCTATGTTTAGAACTTTATATCTTGGGACTTATGTATATATATACCTTTTAAATAAA
ATAAATTTTCTAAATAAAAAGTTG
```

FIGURE 126

MVELFIFLFLLGETPFKVVVKSLSPKELVRIHVPKPLDRNDGTFLMRYRMYETVDEGLKIEVL
YGDEHVAQSPYILKGPVYHEYCECPEDPQAWQKTLSCPTKEPQIAKDFASFPSINLQQMLKEV
PKRFGDERGAIVHYTILNNHVYRRSLGKYTDFKMFSDEILLSLTRKVLLPDLEFYVNLGDWPL
EHRKVNGTPSPIPIISWCGSLDSRDVVLPTYDITHSMLEAMRGVTNDLLSIQGNTGPSWINKT
ERAFFRGRDSREERLQLVQLSKENPQLLDAGITGYFFFQEKEKELGKAKLMGFFDFFKYKYQV
NVDGTVAAYRYPYLMLGDSLVLKQDSPYYEHFYMALEPWKHYVPIKRNLSDLLEKVKWAKEND
EEAKKIAKEGQLMARDLLQPHRLYCYYYQVLQKYAERQSSKPEVRDGMELVPQPEDSTAICQC
HRKKPSREEL

Important features of the protein:
Signal peptide:
amino acids 1-16

N-glycosylation sites.
amino acids 250-254, 363-367 cAMP- and cGMP-dependent protein kinase phosphorylation site.
amino acids 444-448

N-myristoylation site.
amino acids 208-214, 319-325, 388-394

Endoplasmic reticulum targeting sequence.
amino acids 448-453

Mitochondrial energy transfer proteins signature.
amino acids 25-34

FIGURE 127

```
AGCCGTCGGAGGGAGCCGGAGCGCTTCTCCCGAGTTGGTGATAGATTGGTGGTCATCCAACAT
GCAGAAATGAATGAGCAGTGAAAAGCAGCAGAGCCGATGGGTCATGAGGATGTAAGTGCGTTT
GAAGGCTTCCACACCCTCTACTCCAGGAATCATGAATAAACTGGAGGATAAGCAGGACCAGAT
GATACCATGAAGAGAAGTTTACAGGCCCTCTATTGCCAACTGTTAAGTTTCCTGCTGATCTTG
GCACTGACCGAAGCGCTGGCATTTGCCATCCAGGAACCATCTCCCAGGGAATCTCTTCAGGTC
CTCCCTTCAGGCACTCCCCGGGAACCATGGTGACAGCACCCCACAGCTCTACCAGACATACT
TCTGTGGTGATGCTGACCCCAATCCCGATGGACCCCCTCACAGGCTGCAGCTCCCATGGCA
ACACTGACACCCGTGCAGAGGGGCACCCTCCTACGCACACCATCTCCACCATCGCTGCGACA
GTAACCGCCCCCTATTCTGAAAGCTCCCTGTCCACAGGGCCCGCTCCAGCAGCCATGGCAACC
ACATCCTCCAAGCCAGAGGGCCGCCCTCGAGGGCAGGCTGCCCCCACCATCCTGCTGACAAAG
CCACCGGGGGCCACCAGCCGCCCCACCACAGCGCCCCCCGCACTACCACACGCAGGCCCCCC
AGGCCCCCAGGCTCTTCCCGAAAAGGGGCTGGTAATTCATCACGCCCTGTCCCGCCTGCACCT
GGTGGCCACTCCAGGAGTAAAGAAGGACAGCGAGGACGAAATCCAAGCTCCACACCTCTGGGG
CAGAAGCGGCCCCTGGGGAAAATCTTTCAGATCTACAAGGGCAACTTCACAGGGTCTGTGGAA
CCAGAGCCCTCTACCCTCACCCCCAGGACCCCACTCTGGGGCTACTCCTCTTCACCACAGCCC
CAGACAGTGGCTGCGACCACAGTGCCCAGCAATACCTCATGGGCACCCACCACCACCTCCCTG
GGGCCTGCAAAGGACAAGCCAGGCCTTCGCAGAGCAGCCCAGGGGGGTGGTTCTACCTTCACC
AGCCAAGGAGGGACACCAGATGCCACAGCAGCCTCAGGTGCCCCTGTCAGTCCACAAGCTGCC
CCAGTGCCTTCTCAGCGCCCCCACCACGGTGACCCACAGGATGGCCCCAGCCATAGTGACTCT
TGGCTTACTGTTACCCCTGGCACCAGCAGACCTCTGTCTACCAGCTCTGGGGTCTTCACGGCT
GCCACGGGGCCCACCCCAGCTGCCTTCGATACCAGTGTCTCAGCCCCTTCCCAGGGGATTCCT
CAGGGAGCATCCACAACCCCACAAGCTCCAACCCATCCCTCCAGGGTCTCAGAAAGCACTATT
TCTGGAGCCAAGGAGGAGACTGTGGCCACCCTCACCATGACCGACCGGGTGCCCAGTCCTCTC
TCCACAGTGGTATCCACAGCCACAGGCAATTTCCTCAACCGCCTGGTCCCCGCCGGGACCTGG
AAGCCTGGGACAGCAGGGAACATCTCCCATGTGGCCGAGGGGACAAACCGCAGCACAGAGCC
ACCATCTGCCTGAGCAAGATGGATATCGCCTGGGTGATCCTGGCCATCAGCGTGCCCATCTCC
TCCTGCTCTGTCCTGCTGACGGTGTGCTGCATGAAGAGGAAGAAGAAGACCGCCAACCCGGAG
AACAACCTGAGCTACTGGAACAACACCATCACCATGGACTACTTCAACAGGCATGCTGTGGAG
CTGCCCAGGGAGATCCAGTCCCTTGAAACCTCTGAGGACCAGCTCTCAGAGCCCCGCTCCCCA
GCCAATGGCGACTATAGAGACACTGGGATGGTCCTTGTTAACCCCTTCTGTCAAGAAACACTG
TTTGTGGGAAACGATCAAGTATCTGAGATCTAACTACAGCAGGCATCACTTTGCCATTCCGTA
TTTTTCGTCTCTAAATTATAAATATACAAATATATATATTATAAATATAACCTTGTGTAACCC
TGACTTAATGAGAAACATTTTCAGCTTTTTTCCTATGAATTGTCAACATCTTTTTTACAAGT
GTGGTTTAAAAAAAAAAAAACTTTACAGAATGATCTGTGGCTTTATAAAATAAAGGTATTTCT
AAGCAAAAAAAAAAAAAAAAA
```

FIGURE 128

MKRSLQALYCQLLSFLLILALTEALAFAIQEPSPRESLQVLPSGTPPGTMVTAPHSSTRHTSV
VMLTPNPDGPPSQAAAPMATLTPRAEGHPPTHTISTIAATVTAPYSESSLSTGPAPAAMATTS
SKPEGRPRGQAAPTILLTKPPGATSRPTTAPPRTTTRRPPRPPGSSRKGAGNSSRPVPPAPGG
HSRSKEGQRGRNPSSTPLGQKRPLGKIFQIYKGNFTGSVEPEPSTLTPRTPLWGYSSSPQPQT
VAATTVPSNTSWAPTTTSLGPAKDKPGLRRAAQGGGSTFTSQGGTPDATAASGAPVSPQAAPV
PSQRPHHGDPQDGPSHSDSWLTVTPGTSRPLSTSSGVFTAATGPTPAAFDTSVSAPSQGIPQG
ASTTPQAPTHPSRVSESTISGAKEETVATLTMTDRVPSPLSTVVSTATGNFLNRLVPAGTWKP
GTAGNISHVAEGDKPQHRATICLSKMDIAWVILAISVPISSCSVLLTVCCMKRKKKTANPENN
LSYWNNTITMDYFNRHAVELPREIQSLETSEDQLSEPRSPANGDYRDTGMVLVNPFCQETLFV
GNDQVSEI

Important features of the protein:

Signal peptide:
amino acids 1-28

Transmembrane domain:
amino acids 469-487

N-glycosylation sites.
amino acids 178-182, 223-227, 261-265, 446-450, 504-508, 509-513 cAMP- and cGMP-dependent protein kinase phosphorylation site.
amino acids 495-499

N-myristoylation sites.
amino acids 44-50, 48-54, 175-181, 222-228, 279-285, 286-292, 288-294, 296-302, 351-357, 374-380, 427-433, 442-448

TonB-dependent receptor proteins signature 1.
amino acids 1-44

FIGURE 129

AGGCGAGGCGCGGCGCCGCTGCACACACGCACACGGAGCTATGGGGTGCCATGTTGCCACCAG
CTGCCACGTGGCCTGGCTTTTGGTGCTGATCTCTGGATGCTGGGGCCAGGTGAACCGGCTGCC
CTTCTTCACCAACCACTTCTTTGATACATACCTGCTGATCAGCGAGGACACGCCTGTGGGTTC
TTCTGTGACCCAGTTGCTGGCCCAAGACATGGACAATGACCCCCTGGTGTTTGGCGTGTCTGG
GGAGGAGGCCTCTCGCTTCTTTGCAGTGGAGCCTGACACTGGCGTGGTGTGGCTCCGGCAGCC
ACTGGACAGAGAGACCAAGTCAGAGTTCACCGTGGAGTTCTCTGTCAGCGACCACCAGGGGGT
GATCACACGGAAGGTGAACATCCAGGTCGGGGATGTGAATGACAACGCGCCCACATTTCACAA
TCAGCCCTACAGCGTCCGCATCCCTGAGAATACACCAGTGGGGACGCCCATCTTCATCGTGAA
TGCCACAGACCCCGACTTGGGGGCAGGGGGCAGCGTCCTCTACTCCTTCCAGCCCCCCTCCCA
ATTCTTCGCCATTGACAGCGCCCGCGGTATCGTCACAGTGATCCGGGAGCTGGACTACGAGAC
CACACAGGCCTACCAGCTCACGGTCAACGCCACAGATCAAGACAAGACCAGGCCTCTGTCCAC
CCTGGCCAACTTGGCCATCATCATCACAGATGTCCAGGACATGGACCCCATCTTCATCAACCT
GCCTTACAGCACCAACATCTACGAGCATTCTCCTCCGGGCACGACGGTGCGCATCATCACCGC
CATAGACCAGGATAAAGGACGTCCCCGGGGCATTGGCTACACCATCGTTTCAGGGAATACCAA
CAGCATCTTTGCCCTGGACTACATCAGCGGAGTGCTGACCTTGAATGGCCTGCTGGACCGGGA
GAACCCCCTGTACAGCCATGGCTTCATCCTGACTGTGAAGGGCACGGAGCTGAACGATGACCG
CACCCCATCTGACGCTACAGTCACCACGACCTTCAATATCCTGGTTATTGACATCAATGACAA
TGCCCCGGAGTTCAACAGCTCCGAGTACAGCGTGGCCATCACTGAGCTGGCACAGGTCGGCTT
TGCCCTTCCACTCTTCATCCAGGTGGTGGACAAGGATGAGAATTTGGGCCTGAACAGCATGTT
TGAGGTGTACTTGGTGGGGAACAACTCCCACCACTTCATCATCTCCCCGACCTCCGTCCAGGG
GAAGGCGGACATTCGTATTCGGGTGGCCATCCCACTGGACTACGAGACCGTGGACCGCTACGA
CTTTGATCTCTTTGCCAATGAGAGTGTGCCTGACCATGTGGGCTATGCCAAGGTGAAGATCAC
TCTCATCAATGAAAATGACAACCGGCCCATCTTCAGCCAGCCACTGTACAACATCAGCCTGTA
CGAGAACGTCACCGTGGGGACCTCTGTGCTGACAGTCCTGGTGAGTCCCCGCTTCACTGCAGG
GCCACTGAGCTCTCCAGGGCCGACTGTGGTGAGGCACCCAGAGGGATTTTGTCCAAGGGACCT
CAGCAATCAGGGAAGGAGGCACCCCAAATCCCTGAGCTGTGTTTGTTGGTGTATTAAATAAA
GTTTTTGGACTCTTCAGGAAGGGGCTCCCTTGACCTAGGTTGCAATATGGAAAAGGAGCCAAC
CTGAGGGGTGACGAGACTGAGCTGAGGACACTGGTTTTCTGCCTTTCCCTGAGAGAGACTCAG
TGAGGGTGGGCTGGGAGCCCTGGAAGCCCCCTCAAATGGGTGGGAAGGTGCCAGCCATCCTTG
AGAAGGGCAACCCTCTCCATGTGAGCACAGGCACCAGAGAGGGGCAGGCGCCTGGAGGGTACC
GGGGCACCCCAGCTGCCCATGGCTGGACTTGCCCTTTGACAAGGGGCCCTCCCAGTGTCATT
TGTATCTGTCAGTACTCTTGGTTGCAAGGGACAGAAACCCTTAAGTAGTTCAAGCAAAAAGG
ATTGGCTCATGTAACTCAAAAGTATAAGTGATTTCAGGCCGGGCTCGGTGGCTCACGCCTGTC
ATCCAACACCTTGAGAAAGCCGAGGTGGGCGGATCACTTGAGGTCGGGAGTTTGAGACCAGCC
TGGCCAACATGGCAAAACCCCGTCTCTACTAAAAATACAAAAATTAGCCGGGTGTGGTGGCAC
ACGCCTGTAGTCCCAGCTACTAGGGAGGCTGAGGCAGGAGAATCGCTTGAACCCAGGAGGCGG
AGGTTGCAGTGAGCCGAGATTGTGTCACTGCCCTCCAGCCTGGGCGACAGAGCCAGATTCTGT
CTC

FIGURE 130

```
MGCHVATSCHVAWLLVLISGCWGQVNRLPFFTNHFFDTYLLISEDTPVGSSVTQLLAQDMDND
PLVFGVSGEEASRFFAVEPDTGVVWLRQPLDRETKSEFTVEFSVSDHQGVITRKVNIQVGDVN
DNAPTFHNQPYSVRIPENTPVGTPIFIVNATDPDLGAGGSVLYSFQPPSQFFAIDSARGIVTV
IRELDYETTQAYQLTVNATDQDKTRPLSTLANLAIIITDVQDMDPIFINLPYSTNIYEHSPPG
TTVRIITAIDQDKGRPRGIGYTIVSGNTNSIFALDYISGVLTLNGLLDRENPLYSHGFILTVK
GTELNDDRTPSDATVTTTFNILVIDINDNAPEFNSSEYSVAITELAQVGFALPLFIQVVDKDE
NLGLNSMFEVYLVGNNSHHFIISPTSVQGKADIRIRVAIPLDYETVDRYDFDLFANESVPDHV
GYAKVKITLINENDNRPIFSQPLYNISLYENVTVGTSVLTVLVSPRFTAGPLSSPGPTVVRHP
EGFCPRDLSNQGRRHPQIPELCLLVY
```

Important features of the protein:

Signal peptide:
amino acids 1-23

Transmembrane domain:
amino acids 355-374

N-glycosylation sites.
amino acids 155-159, 206-210, 349-353, 393-397, 434-438, 466-470, 472-476

N-myristoylation sites.
amino acids 2-8, 49-55, 162-168, 270-276, 278-284, 316-322

Amidation site.
amino acids 515-519

Prokaryotic membrane lipoprotein lipid attachment site.
amino acids 11-22

Leucine zipper pattern.
amino acids 298-320

PTS HPR component serine phosphorylation site signature.
amino acids 377-393

Cadherins extracellular repeated domain signature.
amino acids 120-131, 336-347

Cadherins extracellular
amino acids 120-144, 336-360

FIGURE 131

GTGGGCCGCCCCTGCTGCTGCCGTCCATGCTGATGTTTGCGGTGATCGTGGCCTCCAGCGGGC
TGCTGCTCATGATCGAGCGGGGCATCCTGGCCGAGATGAAGCCCCTGCCCTGCACCCGCCCG
GCCGCGAGGGCACAGCCTGGCGCGGGAAAGCCCCCAAGCCTGGGGGCCTGTCCCTCAGGGCTG
GGGACGCGGACTTGCAAGTGCGGCAGGACGTCCGGAACAGGACCCTGCGGGCGGTGTGCGGAC
AGCCAGGCATGCCCCGGGACCCCTGGGACTTGCCGGTGGGCAGCGGCGCACCCTGCTGCGCC
ACATCCTCGTAAGTGACCGTTACCGCTTCCTCTACTGCTACGTCCCCAAGGTGGCCTGCTCTA
ACTGGAAGCGGGTGATGAAGGTGCTGGCAGGCGTCCTGGACAGCGTGGACGTCCGCCTCAAGA
TGGACCACCGCAGTGACCTGGTGTTCCTGGCCGACCTGCGGCCTGAGGAGATTCGCTACCGCC
TGCAGCACTACTTTAAGTTCCTGTTTGTGCGGGAGCCCTTGGAACGCCTCCTCTCTGCCTACC
GCAACAAGTTTGGCGAGATCCGAGAGTACCAGCAACGCTATGGGGCTGAGATAGTGAGGCGGT
ACAGGGCTGGAGCGGGGCCCAGCCCTGCAGGCGACGATGTCACATTCCCCGAGTTCCTGAGAT
ACCTGGTGGATGAGGACCCTGAGCGCATGAATGAGCATTGGATGCCCGTGTACCACCTGTGCC
AGCCTTGTGCCGTGCACTATGACTTTGTGGGCTCCTATGAGAGGCTGGAGGCTGATGCAAATC
AGGTGCTGGAGTGGGTACGGGCACCACCTCACGTCCGATTTCCAGCTCGCCAGGCCTGGTACC
GGCCAGCCAGCCCCGAAAGCCTGCATTACCACTTGTGCAGTGCCCCCGGGCCCTGCTGCAGG
ATGTGCTGCCTAAGTATATCCTGGACTTCTCCCTCTTTGCCTACCCACTGCCTAATGTCACCA
AGGAGGCGTGTCAGCAGTGACCATGGGTGTGGGCCAGCAGCTGGTGGGACTGGTTTCAACG
CCAGCTTTCTGTGCTTCTGCCTGTCATTCGGAGAAACTCTGGCTCTGGGGCTTGGGGCTTCTC
AGGATCCTGGATGGCAGAGACTGCCCTCAGAAGTTCCTTGTCCAGGGTGGGCACCCACAGTGA
CTCAGAGGACAGGGCTAGGCAGGAGACCTGCTGCTCCTCATTGGGGGGATCTCTTGGGGGCA
GACACCAGTTTGCCAATGAAGCAACACATCTGATCTAAAGACTGGCTCCAGACCCCGGGCTGC
CAGGATTATGCAGTCCACTTGGTCTACCTTAATTTAACCTGTGGCCAAACTCAGAGATGGTAC
CAGCCAGGGGCAAGCATGACCAGAGCCAGGGACCCTGTGGCTCTGATCCCCATTTATCCACC
CCATGTGCCTCAGGACTAGAGTGAGCAATCATACCTTATAAATGACTTTTGTGCCTTTCTGCT
CCAGTCTCAAAATTTCCTACACCTGCCAGTTCTTTACATTTTTCCAAGGAAAGGAAAACGGAA
GCAGGGTTCTTGCCTGGTAGCTCCAGGACCCAGCTCTGCAGGCACCCAAAGACCCTCTGTGCC
CAGCCTCTTCCTTGAGTTCTCGGAACCTCCTCCCTAATTCTCCCTTCCTTCCCCACAAGGCCT
TTGAGGTTGTGACTGTGGCTGGTATATCTGGCTGCCATTTTTCTGATGCATTTATTTAAAATT
TGTACTTTTTGATAGAACCCTTGTAAGGGCTTTGTTTTCCTAATAGCTGACTTTTAATAAAG
CAGTTTTATATAT

FIGURE 132

MLMFAVIVASSGLLLMIERGILAEMKPLPLHPPGREGTAWRGKAPKPGGLSLRAGDADLQVRQ
DVRNRTLRAVCGQPGMPRDPWDLPVGQRRTLLRHILVSDRYRFLYCYVPKVACSNWKRVMKVL
AGVLDSVDVRLKMDHRSDLVFLADLRPEEIRYRLQHYFKFLFVREPLERLLSAYRNKFGEIRE
YQQRYGAEIVRRYRAGAGPSPAGDDVTFPEFLRYLVDEDPERMNEHWMPVYHLCQPCAVHYDF
VGSYERLEADANQVLEWVRAPPHVRFPARQAWYRPASPESLHYHLCSAPRALLQDVLPKYILD
FSLFAYPLPNVTKEACQQ

Important features of the protein:

Signal peptide:

amino acids 1-23

N-glycosylation sites.

amino acids 67-71, 325-329

Tyrosine kinase phosphorylation sites.

amino acids 152-159, 183-183

N-myristoylation sites.

amino acids 89-95, 128-134

FIGURE 133

CGGCAGTTCTGGCCCCTGCAGCTGGAGGTACCCTGAGTTCTGAGGGTCGTAGTGCTGTTTCTG
GTATTCTCATCGCGGTCACCTCTACCGGTGTGGACAAGTAAAGTTTGAATCAGCTTCTCCATG
GCCTGGGCACCAGTTCCCGGCTGAGCCATTTTCCTTTTGGCTAAAAGTCCCCGCCCAGAGGCC
AATTCGTCGCGGCGGCGGTGGAGATCGCAGGTCGCTCAGGCTTGCAGATGGGTCAAGGGTTGT
GGAGAGTGGTCAGAAACCAGCAGCTGCAACAAGAAGGCTACAGTGAGCAAGGCTACCTCACCA
GAGAGCAGAGCAGGAGAATGGATGCGAGCAACATTTCTAACACCAATCATCGTAAACAAGTCC
AAGGAGGCATTGACATATATCATCTTTTGAAGGCAAGGAAATCGAAAGAACAGGAAGGATTCA
TTAATTTGGAAATGTTGCCTCCTGAGCTAAGCTTTACCATCTTGTCCTACCTGAATGCAACTG
ACCTTTGCTTGGCTTCATGTGTTTGGCAGGACCTTGCGAATGATGAACTTCTCTGGCAAGGGT
TGTGCAAATCCACTTGGGGTCACTGTTCCATATACAATAAGAACCCACCTTTAGGATTTTCTT
TTAGAAAATTGTATATGCAGCTGGATGAAGGCAGCCTCACCTTTAATGCCAACCCAGATGAGG
GAGTGAACTACTTTATGTCCAAGGGTATCCTGGATGATTCGCCAAAGGAAATAGCAAAGTTTA
TCTTCTGTACAAGAACACTAAATTGGAAAAAACTGAGAATCTATCTTGATGAAAGGAGAGATG
TCTTGGATGACCTTGTAACATTGCATAATTTAGAAATCAGTTCTTGCCAAATGCACTGAGAG
AATTTTTTCGTCATATCCATGCCCCTGAAGAGCGTGGAGAGTATCTTGAAACTCTTATAACAA
AGTTCTCACATAGATTCTGTGCTTGCAACCCTGATTTAATGCGAGAACTTGGCCTTAGTCCTG
ATGCTGTCTATGTACTGTGCTACTCTTTGATTCTACTTTCCATTGACCTCACTAGCCCTCATG
TGAAGAATAAAATGTCAAAAAGGGAATTTATTCGAAATACCCGTCGCGCTGCTCAAAATATTA
GTGAAGATTTGTAGGGCATCTTTATGACAATATCTACCTTATTGGCCATGTGGCTGCATAAA
AAGCACAATTGCTAGGACTTCAGTTTTTACTTCAGACTAAAGCTACCCAAGGACTTAGCAGAT
ATGGGGGTTACATCAGTGCTGGTCATTGTAGCCTGAGTATACAATCAAGCTTCAGTGTGCAAC
CTTTTTTTCTTTTGCCATTTTCTATTTTAGTAATTTCCTTGGGGAACTAAATAATTTTGCAGA
ATTTTTCCTAATTTTGTTTATCACGTTTTGCACAAAGCAGAGCCACTGTCTAACACAGCTGTT
AACGAATGATAAACTGACATTATACTCTAAAAGATGGTGTATTTGTGCATTAGATTTGCCTGA
AAAACTTTATCCATTTCCATTCTTTATACAAATACCATGTAATGTGTACATATTTAACTAAAG
AGATTTATAGTCATAATTATTTTATTGTAAAGATTTTAACTAAAGTTTTTCCTTTTCTCTC

FIGURE 134

MGQGLWRVVRNQQLQQEGYSEQGYLTREQSRRMDASNISNTNHRKQVQGGIDIYHLLKARKSK
EQEGFINLEMLPPELSFTILSYLNATDLCLASCVWQDLANDELLWQGLCKSTWGHCSIYNKNP
PLGFSFRKLYMQLDEGSLTFNANPDEGVNYFMSKGILDDSPKEIAKFIFCTRTLNWKKLRIYL
DERRDVLDDLVTLHNFRNQFLPNALREFFRHIHAPEERGEYLETLITKFSHRFCACNPDLMRE
LGLSPDAVYVLCYSLILLSIDLTSPHVKNKMSKREFIRNTRRAAQNISEDFVGHLYDNIYLIG
HVAA

Important features of the protein:

Transmembrane domain:

amino acids 253-272

N-glycosylation sites.

amino acids 37-41, 87-91, 298-302

N-myristoylation site.

amino acids 110-116

FIGURE 135

```
GGCACGAGGGAGCCTCCGTTAGGGGGTGGGAAAGGACTTTGCCATAGGTCGCTGAGGCCACCA
TCTGCTCTCTTACTGGCCAAGGGCGTAAAAGATAGTCTTCCCATTAGCTAGAGAGCAAACCC
CAGAAAGCCTATTGGCTGCGCCGTCCGCGGGCCTTGGTCCGCTTTGAAGGCGGGCTGCGGCTG
CGAGAGGAGGGCGGGCGGGAGGCTAGCTGTTGTCGTGGTTGCTCGGAGGCACGTGTGCAGTCC
CGGAAGCGGCGAGGGGAAACTGCTCCGCGCGCGCCGCGGGAGGAGGAACCGCCCGGTCCTTTA
GGGTCCGGGCCCGGCCGGGCCATGGATTCAATGCCTGAGCCCGCGTCCCGCTGTCTTCTGCTT
CTTCCCTTGCTGCTGCTGCTGCTGCTGCTGCCGGCCCCGGAGCTGGGCCCGAGCCAGGCC
GGAGCTGAGGAGAACGACTGGGTTCGCCTGCCCAGCAAATGCGAAGTGTGTAAATATGTTGCT
GTGGAGCTGAAGTCAGCCTTTGAGGAAACCGGCAAGACCAAGGAGGTGATTGGCACGGGCTAT
GGCATCCTGGACCAGAAGGCCTCTGGAGTCAAATACACCAAGTCGGACTTGCGGTTAATCGAA
GTCACTGAGACCATTTGCAAGAGGCTCCTGGATTATAGCCTGCACAAGGAGAGGACCGGCAGC
AATCGATTTGCCAAGGGCATGTCAGAGACCTTTGAGACATTACACAACCTGGTACACAAAGGG
GTCAAGGTGGTGATGGACATCCCCTATGAGCTGTGGAACGAGACTTCTGCAGAGGTGGCTGAC
CTCAAGAAGCAGTGTGATGTGCTGGTGGAAGAGTTTGAGGAGGTGATCGAGGACTGGTACAGG
AACCACCAGGAGGAAGACCTGACTGAATTCCTCTGCGCCAACCACGTGCTGAAGGGAAAAGAC
ACCAGTTGCCTGGCAGAGCAGTGGTCCGGCAAGAAGGGAGACACAGCTGCCCTGGGAGGGAAG
AAGTCCAAGAAGAAGAGCAGCAGGGCCAAGGCAGCAGGCGGCAGGAGTAGCAGCAGCAAACAA
AGGAAGGAGCTGGGTGGCCTTGAGGGAGACCCCAGCCCCGAGGAGGATGAGGGCATCCAGAAG
GCATCCCCTCTCACACACAGCCCCCCTGATGAGCTCTGAGCCCACCCAGCATCCTCTGTCCTG
AGACCCTGATTTTGAAGCTGAGGAGTCAGGGGCATGGCTCTGGCAGGCCGGGATGGCCCCGC
AGCCTTCAGCCCCTCCTTGCCTTGGCTGTGCCCTCTTCTGCCAAGGAAAGACACAAGCCCCAG
GAAGAACTCAGAGCCGTCATGGGTAGCCCACGCCGTCCTTTCCCCTCCCCAAGTGTTTCTCTC
CTGACCCAGGGTTCAGGCAGGCCTTGTGGTTTCAGGACTGCAAGGACTCCAGTGTGAACTCAG
GAGGGGCAGGTGTCAGAACTGGGCACCAGGACTGGAGCCCCCTCCGGAGACCAAACTCACCAT
CCCTCAGTCCTCCCCAACAGGGTACTAGGACTGCAGCCCCCTGTAGCTCCTCTCTGCTTACCC
CTCCTGTGGACACCTTGCACTCTGCCTGGCCCTTCCCAGAGCCCAAAGAGTAAAAATGTTCTG
GTTCTGATTTCTGAAAAAAAAAAAAAAAAAAATTCCT
```

FIGURE 136

MDSMPEPASRCLLLLPLLLLLLLLLLPAPELGPSQAGAEENDWVRLPSKCEVCKYVAVELKSAF
EETGKTKEVIGTGYGILDQKASGVKYTKSDLRLIEVTETICKRLLDYSLHKERTGSNRFAKGM
SETFETLHNLVHKGVKVVMDIPYELWNETSAEVADLKKQCDVLVEEFEEVIEDWYRNHQEEDL
TEFLCANHVLKGKDTSCLAEQWSGKKGDTAALGGKKSKKKSSRAKAAGGRSSSSKQRKELGGL
EGDPSPEEDEGIQKASPLTHSPPDEL

Important features of the protein:

Signal peptide:

amino acids 1-26

N-glycosylation site.

amino acids 153-157 cAMP- and cGMP-dependent protein kinase phosphorylation sites.

amino acids 227-231, 228-232

Tyrosine kinase phosphorylation site.

amino acids 142-150

N-myristoylation sites.

amino acids 36-42, 74-80, 86-92, 125-131, 222-228, 237-243, 250-256, 263-269

Amidation sites.

amino acids 212-216, 222-226

ATP/GTP-binding site motif A (P-loop).

amino acids 62-70

FIGURE 137

CACGCCTCCCGCTGCCAGCCCGGCACCGGGATCTTAATCAGTCACTATGAAAACTCATTAGCT
CCACAGCAATGAGTCCTCCACTGCTGAAGCTTGGCGCTGTGCTTAGTACCATGGCAATGATCT
CAAACTGGATGTCCCAAACTCTCCCATCCTTGGTGGGACTGAACACCACGAGGCTGTCGACTC
CGGATACCTTAACTCAGATTAGTCCTAAAGAAGGGTGGCAGGTGTACAGCTCAGCTCAGGATC
CTGATGGGCGGTGCATTTGCACAGTTGTTGCTCCAGAACAAAACCTGTGTTCCCGGGATGCCA
AAAGCAGGCAACTTCGCCAACTACTGGAAAAGGTTCAGAACATGTCCCAGTCTATTGAAGTCT
TAAACTTGAGAACTCAGAGAGATTTCCAATATGTTTTAAAAATGGAAACCCAAATGAAAGGGC
TGAAGGCAAAATTTCGGCAGATTGAAGATGATCGAAAGACACTTATGACCAAGCATTTTCAGG
AGTTGAAAGAGAAAATGGACGAGCTCCTGCCTTTGATCCCCGTGCTGGAACAGTACAAAACAG
ATGCTAAGTTAATCACCCAGTTCAAGGAGGAAATAAGGAATCTGTCTGCTGTCCTCACTGGTA
TTCAGGAGGAAATTGGTGCCTATGACTACGAGGAACTACACCAAAGAGTGCTGAGCTTGGAAA
CAAGACTTCGTGACTGCATGAAAAAGCTAACATGTGGCAAACTGATGAAAATCACAGGCCCAG
TTACAGTCAAGACATCTGGAACCCGATTTGGTGCTTGGATGACAGACCCTTTAGCATCTGAGA
AAAACAACAGAGTCTGGTACATGGACAGTTATACTAACAATAAAATTGTTCGTGAATACAAAT
CAATTGCAGACTTTGTCAGTGGGGCTGAATCAAGGACATACAACCTTCCTTTCAAGTGGGCAG
GAACTAACCATGTTGTCTACAATGGCTCACTCTATTTTAACAAGTATCAGAGTAATATCATCA
TCAAATACAGCTTTGATATGGGGAGAGTGCTTGCCCAACGAAGCCTGGAGTATGCTGGTTTTC
ATAATGTTTACCCCTACACATGGGGTGGATTCTCTGACATCGACCTAATGGCTGATGAAATCG
GGCTGTGGGCTGTGTATGCAACTAACCAGAATGCAGGCAATATTGTCATCAGCCAACTTAACC
AAGATACCTTGGAGGTGATGAAGAGCTGGAGCACTGGCTACCCCAAGAGAAGTGCAGGGGAAT
CTTTCATGATCTGTGGGACACTGTATGTCACCAACTCCCACTTAACTGGAGCCAAGGTGTATT
ATTCCTATTCCACCAAAACCTCCACATATGAGTACACAGACATTCCCTTCCATAACCAATACT
TTCACATATCCATGCTTGACTACAATGCAAGAGATCGAGCTCTCTATGCCTGGAACAATGGCC
ACCAGGTGCTGTTCAATGTCACCCTTTTCCATATCATCAAGACAGAGGATGACACATAGGCAA
ATGTGACATGTTTTCATTGATTTAAACAGTGTGATTTGTGATAAACTCTATAAGACCCCTTCC
GTTTTTTTCTTCACTATTATTTTTCATCATTTCTCCAAAGCAAAGCATTTTATTGTAAAGTT
GGTGTTTCAAAAACATAGCTGAGCTTGTCTAACTTACCATGTTGGAAACACATCTTAACTTCT
AAATTTACAAGGCCTATCATGTCCTTGTCATGAAAAGCACTAAAAAAAAAAAAGAGTTTAAGT
GGCTAAAGTCATAGTTTTGCAAGAGATTAATGATCTGCCTTATATTAGAGTCAGAGACTAATG
GTGGCTTAAATGCACGAATGTCTTTTTTTTAAAACTGTCATTTTTTACTGTCTTTTGCTCCA
TCTCAGGAAATATTTTGGTAGGAATTAGGAGAACAAAAAGCACTTTTATCCCATTTATTTCTT
TAAAAAATGTAAGGATTTCATTTATATTGAAAATAATATTAATCATTTTGCTGTTAACACAA
TTCTCTGATGCGGTGCTGTACAGTCATTTTAAATCTCTTGCTAACATTTTATTGGCAGTATG
TATTTCTACCATTGTAACCACCATTGTGCTATTGTATCTCTTCACTTCTGTGAAAGTAATATT
TTTTATAAAANACACTGNAATTTTAAAAAAAAAAAAAAAAAACAAAAAAAAAAAAAAAAAAAA

FIGURE 138

MSPPLLKLGAVLSTMAMISNWMSQTLPSLVGLNTTRLSTPDTLTQISPKEGWQVYSSAQDPDG
RCICTVVAPEQNLCSRDAKSRQLRQLLEKVQNMSQSIEVLNLRTQRDFQYVLKMETQMKGLKA
KFRQIEDDRKTLMTKHFQELKEKMDELLPLIPVLEQYKTDAKLITQFKEEIRNLSAVLTGIQE
EIGAYDYEELHQRVLSLETRLRDCMKKLTCGKLMKITGPVTVKTSGTRFGAWMTDPLASEKNN
RVWYMDSYTNNKIVREYKSIADFVSGAESRTYNLPFKWAGTNHVVYNGSLYFNKYQSNIIIKY
SFDMGRVLAQRSLEYAGFHNVYPYTWGGFSDIDLMADEIGLWAVYATNQNAGNIVISQLNQDT
LEVMKSWSTGYPKRSAGESFMICGTLYVTNSHLTGAKVYYSYSTKTSTYEYTDIPFHNQYFHI
SMLDYNARDRALYAWNNGHQVLFNVTLFHIIKTEDDT

Important features of the protein:
Signal peptide:
amino acids 1-16

N-glycosylation sites.
amino acids 33-37, 95-99, 179-183, 299-303, 465-469 cAMP- and cGMP-dependent protein kinase phosphorylation site.
amino acids 215-219

Tyrosine kinase phosphorylation site.
amino acids 106-114

N-myristoylation sites.
amino acids 9-15, 31-37, 235-241, 239-245

FIGURE 139

GAAGCAGTGCAGAGAGGAGAGCGGAGCGGAGCTGCCGCTGAGCAAAGGCCTTCACC<u>ATG</u>GCCG
AGTCCCCCGGCTGCTGCTCCGTCTGGGCCCGCTGCCTCCACTGCCTGTATAGCTGCCACTGGA
GGAAATGCCCCAGAGAGAGGATGCAAACCAGCAAGTGCGACTGTATCTGGTTTGGCCTGCTCT
TCCTCACCTTCCTCCTTTCCCTGAGCTGGCTGTACATCGGGCTCGTCCTTCTCAATGACCTGC
ACAACTTCAATGAATTCCTCTTCCGCCGCTGGGGACACTGGATGGACTGGTCCCTGGCATTCC
TGCTGGTCATCTCTCTACTGGTCACATATGCATCCTTGCTATTGGTCCTGGCCCTGCTCCTGC
GGCTTTGTAGACAGCCCCTGCATCTGCACAGCCTCCACAAGGTGCTGCTGCTCCTCATTATGC
TGCTTGTGGCGGCTGGCCTTGTGGGACTGGACATCCAATGGCAGCAGGAGTGGCATAGCTTGC
GTGTGTCACTGCAGGCCACAGCCCCATTCCTTCATATTGGAGCAGCCGCTGGAATTGCCCTCC
TGGCCTGGCCTGTGGCTGATACCTTCTACCGTATCCACCGAAGAGGTCCCAAGATTCTGCTAC
TGCTCCTATTTTTTGGAGTTGTCCTGGTCATCTACTTGGCCCCCCTATGCATCTCCTCACCCT
GCATCATGGAACCCAGAGACTTACCACCCAAGCCTGGGCTGGTGGGACACCGAGGGGCCCCCA
TGCTGGCTCCCGAGAACACCCTGATGTCCTTGCGGAAGACAGCTGAATGCGGAGCTACTGTGT
TTGAGACTGATGTGATGGTCAGCTCCGATGGGGTCCCCTTCCTCATGCATGATGAGCACCTCA
GCAGGACCACGAATGTAGCCTCTGTATTCCCAACCCGAATCACAGCCCACAGCAGTGACTTCT
CCTGGACTGAACTGAAGAGACTCAATGCTGGATCCTGGTTCCTAGAGAGGCGACCCTTCTGGG
GGGCCAAACCGCTGGCAGGCCCTGATCAGAAAGAGGCTGAGAGTCAGACGGTACCAGCATTAG
AAGAGCTATTGGAGGAAGCTGCAGCCCTCAACCTTTCCATCATGTTCGACTTGCGCCGACCCC
CACAGAACCACACATACTATGACACTTTTGTGATCCAGACATTGGAGACTGTGCTGAATGCAA
GGGTGCCCCAAGCCATGGTCTTTTGGCTACCAGATGAAGATCGGGCTAATGTCCAACGACGGG
CACCTGGAATGCGCCAGATATATGGACGTCAGGGAGGCAACAGAACGGAGAGGCCCCAGTTTC
TTAACCTCCCCTATCAAGATCTGCCACTATTGGATATCAAGGCATTGCATAAGGATAATGTCT
CGGTGAACCTATTTGTAGTGAACAAGCCCTGGCTCTTCTCTCTGCTTTGGTGTGCAGGGGTGG
ATTCGGTCACCACCAACGACTGCCAGCTGCTGCAGCAGATGCGTTACCCTATCTGGCTTATTA
CCCCTCAAACCTACCTAATCATATGGGTCATTACCAATTGTGTTTCCACCATGCTGCTTTTGT
GGACCTTCCTCCTCCAAAGGAGATTTGTTAAGAAGAGAGGGAAAACTGGCTTAGAAACAGCAG
TGCTGCTGACAAGGATCAACAATTTCATGATGGAG<u>TGA</u>ATGCCCTGCCCTGCTTCCCCACCCA
AGCCAGTCTACATTGCCCAAACAGCAAGGGTTGGAGAGTGGCTTAAGTGGAATGCTTCAGGGG
TGGTGGGTTGCAAGTGGGGGGAGCTTTGCCAACAGGAGGTTTTGAACCATGAGGGCCCTCTGC
CCAGGTGATGGGCATTCCCTAAGCTGCTATGGAATCTGCTCCCTTTGGGGTTTTGACCTGAGA
TGTTTGGGAAGAGAGTGAGTAATGAGAAGTTTCTCCTCAAATGAAACTAGAACAGAGGAAGTA
AAAGGGAGATTGCTCGGA

FIGURE 140

MAESPGCCSVWARCLHCLYSCHWRKCPRERMQTSKCDCIWFGLLFLTFLLSLSWLYIGLVLLN
DLHNFNEFLFRRWGHWMDWSLAFLLVISLLVTYASLLLVLALLLRLCRQPLHLHSLHKVLLLL
IMLLVAAGLVGLDIQWQQEWHSLRVSLQATAPFLHIGAAAGIALLAWPVADTFYRIHRRGPKI
LLLLLFFGVVLVIYLAPLCISSPCIMEPRDLPPKPGLVGHRGAPMLAPENTLMSLRKTAECGA
TVFETDVMVSSDGVPFLMHDEHLSRTTNVASVFPTRITAHSSDFSWTELKRLNAGSWFLERRP
FWGAKPLAGPDQKEAESQTVPALEELLEEAAALNLSIMFDLRRPPQNHTYYDTFVIQTLETVL
NARVPQAMVFWLPDEDRANVQRRAPGMRQIYGRQGGNRTERPQFLNLPYQDLPLLDIKALHKD
NVSVNLFVVNKPWLFSLLWCAGVDSVTTNDCQLLQQMRYPIWLITPQTYLIIWVITNCVSTML
LLWTFLLQRRFVKKRGKTGLETAVLLTRINNFMME

Important features of the protein:

Transmembrane domains:

amino acids 38-60, 83-107, 122-138, 156-173, 189-210, 484-506

N-glycosylation sites.

amino acids 349-353, 362-366, 415-419, 442-446

N-myristoylation sites.

amino acids 163-169, 413-419, 523-529

Leucine zipper pattern.

amino acids 93-115, 109-131

Glutamine amidotransferases class-II active site.

amino acids 1-13

FIGURE 141

```
GCCGCCGGCCCGGGCTGGAGCCGAGCGCAGCAGCCACCGCCGCCGCCGCGCCAGAAGTTTGGGTTGAACCGGAGC
TGCCGGGAGGAAACTTTTTTCTTTTTTCCCCCTCCCTCCCGGGAGGAGGAGGAGGAGGAGGAGGGGAAGCTGCCG
CCGGCGCCAAGGCTCGTGGGCTCGGGGTCGGCGCGGCCCGCAGAAGGGGCGGGGGCCTCGCCCCGCGAGGGGAGG
CGCGCCCCGGGGGCCCCGAGAGGGGCGGTGAGGACCGCGGGCTGCTGGTGCGGCGGCGGCGCGTGTGCCCCG
CGCAGGGGAGGGCGCCCGCCCCGCTCCCGGCCCGGCTGCGAGGAGGAGGCGGCGGCGGCGCAGGAGGATGTACTT
GGTGGCGGGGACAGGGGGTTGGCCGGCTGCGGCACCTCCTGGTCTCGCTGCTGGGCTGCTGCTGCTGGC
GCGCTCCGGCACCCGGGCGCTGGTCTGCCTGCCCTGTGACGAGTCCAAGTGCGAGGAGCCCAGGAACTGCCCGGG
GAGCATCGTGCAGGGCGTCTGCGGCTGCTGCTACACGTGCGCCAGCCAGAGGAACGAGAGCTGCGGCGGCACCTT
CGGGATTTACGGAACCTGCGACCGGGGGCTGCGTTGTGTCATCCGCCCCCGCTCAATGGCGACTCCCTCACCGA
GTACGAAGCGGGCGTTTGCGAAGATGAGAACTGGACTGATGACCAACTGCTTGGTTTTAAACCATGCAATGAAAA
CCTTATTGCTGGCTGCAATATAATCAATGGGAAATGTGAATGTAACACCATTCGAACCTGCAGCAATCCCTTTGA
GTTTCCAAGTCAGGATATGTGCCTTTCAGCTTTAAAGAGAATTGAAGAAGAGAAGCCAGATTGCTCCAAGGCCCG
CTGTGAAGTCCAGTTCTCTCCACGTTGTCCTGAAGATTCTGTTCTGATCGAGGGTTATGCTCCTCCTGGGGAGTG
CTGTCCCTTACCCAGCCGCTGCGTGTGCAACCCCGCAGGCTGTCTGCGCAAAGTCTGCCAGCCGGGAAACCTGAA
CATACTAGTGTCAAAAGCCTCAGGGAAGCCGGGAGAGTGCTGTGACCTCTATGAGTGCAAACCAGTTTTCGGCGT
GGACTGCAGGACTGTGGAATGCCCTCCTGTTCAGCAGACCGCGTGTCCCCGGACAGCTATGAAACTCAAGTCAG
ACTAACTGCAGATGGTTGCTGTACTTTGCCAACAAGATGCGAGTGTCTCTCTGGCTTATGTGGTTTCCCGTGTG
TGAGGTGGGATCCACTCCCCGCATAGTCTCTCGTGGCGATGGGACACCTGGAAAGTGCTGTGATGTCTTTGAATG
TGTTAATGATACAAAGCCAGCCTGCGTATTTAACAATGTGGAATATTATGATGGAGACATGTTTCGAATGGACAA
CTGTCGGTTCTGTCGATGCCAAGGGGGCGTTGCCATCTGCTTCACTGCCCAGTGTGGTGAGATAAACTGCGAGAG
GTACTACGTGCCCGAAGGAGAGTGCTGCCCAGTGTGTGAAGATCCAGTGTATCCTTTTAATAATCCCGCTGGCTG
CTATGCCAATGGCCTGATCCTTGCCCACGGAGACCGGTGGCGGGAAGACGACTGCACATTCTGCCAGTGCGTCAA
CGGTGAACGCCACTGCGTTGCGACCGTCTGCGGACAGACCTGCACAAACCCTGTGAAAGTGCCTGGGGAGTGTTG
CCCTGTGTGCGAAGAACCAACCATCATCACAGTTGATCCACCTGCATGTGGGGAGTTATCAAACTGCACTCTGAC
AGGGAAGGACTGCATTAATGGTTTCAAACGCGATCACAATGGTTGTCGGACCTGTCAGTGCATAAACACCGAGGA
ACTATGTTCAGAACGTAAACAAGGCTGCACCTTGAACTGTCCCTTCGGTTTCCTTACTGATGCCCAAAACTGTGA
GATCTGTGAGTGCCGCCCAAGGCCCAAGAAGTGCAGACCCATAATCTGTGACAAGTATTGTCCACTTGGATTGCT
GAAGAATAAGCACGGCTGTGACATCTGTCGCTGTAAGAAATGTCCAGAGCTCTCATGCAGTAAGATCTGCCCCTT
GGGTTTCCAGCAGGACAGTGCACGGCTGTCTTATCTGCAAGTGCAGAGAGGCCTCTGCTTCAGCTGGGCCACCCAT
CCTGTCGGGCACTTGTCTCACCGTGGATGGTCATCATCATAAAAATGAGGAGACTGGCACGATGGGTGCCGGGA
ATGCTACTGTCTCAATGGACGGGAAATGTGTGCCCTGATCACCTGCCCGGTGCCTGCCTGTGGCAACCCCACCAT
TCACCCTGGACAGTGCTGCCCATCATGTGCAGATGACTTTGTGGTGCAGAAGCCAGAGCTCAGTACTCCCTCCAT
TTGCCACGCCCCTGGAGGAGAATACTTTGTGGAAGGAGAAACGTGGAACATTGACTCCTGTACTCAGTGCACCTG
CCACAGCGGACGGGTGCTGTGTGAGACAGAGGTGTGCCCACCGCTGCTCTGCCAGAACCCCTCACGCACCCAGGA
TTCCTGCTGCCCACAGTGTACAGATCAACCTTTTCGGCCTTCCTTGTCCCGCAATAACAGCGTACCTAATTACTG
CAAAAATGATGAAGGGGATATATTCCTGGCAGCTGAGTCCTGGAAGCCTGACGTTTGTACCAGCTGCATCTGCAT
TGATAGCGTAATTAGCTGTTTCTCTGAGTCCTGCCCTTCTGTATCCTGTGAAAGACCTGTCTTGAGAAAAGGCCA
GTGTTGTCCCTACTGCATAGAAGACACAATTCCAAAGAAGGTGGTGTGCCACTTCAGTGGGAAGGCCTATGCCGA
CGAGGAGCGGTGGGACCTTGACAGCTGCACCCACTGCTACTGCCTGCAGGGCCAGACCCTCTGCTCGACCGTCAG
CTGCCCCCCTCTGCCCTGTGTTGAGCCCATCAACGTGGAAGGAAGTTGCTGCCCAATGTGTCCAGAAATGTATGT
CCCAGAACCAACCAATATACCCATTGAGAAGACAAACCATCGAGGAGAGGTTGACCTGGAGGTTCCCCTGTGGCC
CACGCCTAGTGAAAATGATATCGTCCATCTCCCTAGAGATATGGGTCACCTCCAGGTAGATTACAGAGATAACAG
GCTGCACCCAAGTGAAGATTCTTCACTGGACTCCATTGCCTCAGTTGTGGTTCCCATAATTATATGCCTCTCTAT
TATAATAGCATTCCTATTCATCAATCAGAAGAAACAGTGGATACCACTGCTTTGCTGGTATCGAACACCAACTAA
GCCTTCTTCCTTAAATAATCAGCTAGTATCTGTGGACTGCAAGAAAGGAACCAGAGTCCAGGTGGACAGTTCCCA
GAGAATGCTAAGAATTGCAGAACCAGATGCAAGATTCAGTGGCTTCTACAGCATGCAAAAACAGAACCATCTACA
GGCAGACAATTTCTACCAAACAGTGTGAAGAAAGGCAACTAGGATGAGGTTTCAAAAGACGGAAGACGACTAAAT
CTGCTCTAAAAAGTAAACTAGAATTTGTGCACTTGCTTAGTGGATTGTATTGGATTGTGACTTGATGTACAGCGC
TAAGACCTTACTGGGATGGGCTCTGTCTACAGCAATGTGCAGAACAAGCATTCCCACTTTTCCTCAAAAAA
```

FIGURE 142

```
MYLVAGDRGLAGCGHLLVSLLGLLLLLARSGTRALVCLPCDESKCEEPRNCPGSIVQGVCGCC
YTCASQRNESCGGTFGIYGTCDRGLRCVIRPPLNGDSLTEYEAGVCEDENWTDDQLLGFKPCN
ENLIAGCNIINGKCECNTIRTCSNPFEFPSQDMCLSALKRIEEEKPDCSKARCEVQFSPRCPE
DSVLIEGYAPPGECCPLPSRCVCNPAGCLRKVCQPGNLNILVSKASGKPGECCDLYECKPVFG
VDCRTVECPPVQQTACPPDSYETQVRLTADGCCTLPTRCECLSGLCGFPVCEVGSTPRIVSRG
DGTPGKCCDVFECVNDTKPACVFNNVEYYDGDMFRMDNCRFCRCQGGVAICFTAQCGEINCER
YYVPEGECCPVCEDPVYPFNNPAGCYANGLILAHGDRWREDDCTFCQCVNGERHCVATVCGQT
CTNPVKVPGECCPVCEEPTIITVDPPACGELSNCTLTGKDCINGFKRDHNGCRTCQCINTEEL
CSERKQGCTLNCPFGFLTDAQNCEICECRPRPKKCRPIICDKYCPLGLLKNKHGCDICRCKKC
PELSCSKICPLGFQQDSHGCLICKCREASASAGPPILSGTCLTVDGHHHKNEESWHDGCRECY
CLNGREMCALITCPVPACGNPTIHPGQCCPSCADDFVVQKPELSTPSICHAPGGEYFVEGETW
NIDSCTQCTCHSGRVLCETEVCPPLLCQNPSRTQDSCCPQCTDQPFRPSLSRNNSVPNYCKND
EGDIFLAAESWKPDVCTSCICIDSVISCFSESCPSVSCERPVLRKGQCCPYCIEDTIPKKVVC
HFSGKAYADEERWDLDSCTHCYCLQGQTLCSTVSCPPLPCVEPINVEGSCCPMCPEMYVPEPT
NIPIEKTNHRGEVDLEVPLWPTPSENDIVHLPRDMGHLQVDYRDNRLHPSEDSSLDSIASVVV
PIIICLSIIIAFLFINQKKQWIPLLCWYRTPTKPSSLNNQLVSVDCKKGTRVQVDSSQRMLRI
AEPDARFSGFYSMQKQNHLQADNFYQTV
```

Important features of the protein:

Signal peptide:

amino acids 1-34

Transmembrane domain:

amino acids 940-962

N-glycosylation sites.

amino acids 71-75, 113-117, 330-334, 474-478, 746-750 cAMP- and cGMP-dependent protein kinase phosphorylation site.

amino acids 992-996

N-myristoylation site.

amino acids 9-15, 58-64, 61-67, 75-81, 79-85, 362-368, 402-408, 407-413, 439-445, 492-498, 511-517, 551-557, 558-564, 586-592, 606-612, 625-631, 845-851

Prokaryotic membrane lipoprotein lipid attachment site.

amino acids 52-63, 844-855

Cell attachment sequence.

amino acids 314-317

Leucine zipper pattern.

amino acids 3-25

Eukaryotic thiol (cysteine) proteases cysteine active site.

amino acids 57-69

VWFC domain proteins.

amino acids 448-456, 382-390

C-terminal cystine knot proteins amino acids 60-86

FIGURE 143

```
GACGTCTGGCCGGCTCCCGGCGAAGGGCAGCGGAGGAGCGGCCCAGAGCGCGCAGCTAGGGCA
CTGGCGAAACCCCGGGACAGTCCCTCTCCGTGCGGGGGCGGCGCAGAGCAGTCCCATCCCCGG
GGTCCCGGGCGCGGCTGACTGCCGGCTGGTTCCCTGCGCGCAGTAGCTCCCCGAGCCGGGCTG
CACCGGAGGCGGCGAGATGGTCGCGCGCGTCGGCCTCCTGCTGCGCGCCCTGCAGCTGCTACT
GTGGGGCCACCTGGACGCCCAGCCCGCGGAGCGCGGAGGCCAGGAGCTGCGCAAGGAGGCGGA
GGCATTCCTAGAGAAGTACGGATACCTCAATGAACAGGTCCCCAAAGCTCCCACCTCCACTCG
ATTCAGCGATGCCATCAGAGCGTTTCAGTGGGTGTCCCAGCTACCTGTCAGCGGCGTGTTGGA
CCGCGCCACCCTGCGCCAGATGACTCGTCCCCGCTGCGGGGTTACAGATACCAACAGTTATGC
GGCCTGGGCTGAGAGGATCAGTGACTTGTTTGCTAGACACCGGACCAAAATGAGGCGTAAGAA
ACGCTTTGCAAAGCAAGGTAACAAATGGTACAAGCAGCACCTCTCCTACCGCCTGGTGAACTG
GCCTGAGCATCTGCCGGAGCCGGCAGTTCGGGGCGCCGTGCGCGCCGCCTTCCAGTTGTGGAG
CAACGTCTCAGCGCTGGAGTTCTGGGAGGCCCCAGCCACAGGCCCCGCTGACATCCGGCTCAC
CTTCTTCCAAGGGGACCACAACGATGGGCTGGGCAATGCCTTTGATGGCCCAGGGGCGCCCT
GGCGCACGCCTTCCTGCCCCGCCGCGGCGAAGCGCACTTCGACCAAGATGAGCGCTGGTCCCT
GAGCCGCCGCCGCGGGCGCAACCTGTTCGTGGTGCTGGCGCACGAGATCGGTCACACGCTTGG
CCTCACCCACTCGCCCGCCGCGCGCGCTCATGGCGCCCTACTACAAGAGGCTGGGCCGCGA
CGCGCTGCTCAGCTGGGACGACGTGCTGGCCGTGCAGAGCCTGTATGGGAAGCCCCTAGGGGG
CTCAGTGGCCGTCCAGCTCCCAGGAAAGCTGTTCACTGACTTTGAGACCTGGGACTCCTACAG
CCCCCAAGGAAGGCGCCCTGAAACGCAGGGCCCTAAATACTGCCACTCTTCCTTCGATGCCAT
CACTGTAGACAGGCAACAGCAACTGTACATTTTTAAAGGGAGCCATTTCTGGGAGGTGGCAGC
TGATGGCAACGTCTCAGAGCCCCGTCCACTGCAGGAAAGATGGGTCGGGCTGCCCCCCAACAT
TGAGGCTGCGGCAGTGTCATTGAATGATGGAGATTTCTACTTCTTCAAAGGGGGTCGATGCTG
GAGGTTCCGGGGCCCCAAGCCAGTGTGGGGTCTCCCACAGCTGTGCCGGGCAGGGGCCTGCC
CCGCCATCCTGACGCCGCCCTCTTCTTCCCTCCTCTGCGCCGCCTCATCCTCTTCAAGGGTGC
CCGCTACTACGTGCTGGCCCGAGGGGGACTGCAAGTGGAGCCCTACTACCCCGAAGTCTGCA
GGACTGGGGAGGCATCCCTGAGGAGGTCAGCGGCGCCCTGCCGAGGCCCGATGGCTCCATCAT
CTTCTTCCGAGATGACCGCTACTGGCGCCTCGACCAGGCCAAACTGCAGGCAACCACCTCGGG
CCGCTGGGCCACCGAGCTGCCCTGGATGGCTGCTGGCATGCCAACTCGGGGAGCGCCCTGTT
CTGAAGGCACCTCCTCACCTCAGAAACTGGTGGTGCTCTCAGGGCAAAATCATGTTCCCCACC
CCCGGGGCAGAACCCCTCTTAGAAGCCTCTGAGTCCCTCTGCAGAAGACCGGGCAGCAAAGCC
TCCATCTGGAAGTCTGTCTGCCTTTGTTCCTTGGAAAAAAAAAAAAAAAAAAAAAAAAAAAAA
AAAAAAAAAAAAAAAAAAAAAAAAAAAAAA
```

FIGURE 144

MVARVGLLLRALQLLLWGHLDAQPAERGGQELRKEAEAFLEKYGYLNEQVPKAPTSTRFSDAI
RAFQWVSQLPVSGVLDRATLRQMTRPRCGVTDTNSYAAWAERISDLFARHRTKMRRKKRFAKQ
GNKWYKQHLSYRLVNWPEHLPEPAVRGAVRAAFQLWSNVSALEFWEAPATGPADIRLTFFQGD
HNDGLGNAFDGPGGALAHAFLPRRGEAHFDQDERWSLSRRRGRNLFVVLAHEIGHTLGLTHSP
APRALMAPYYKRLGRDALLSWDDVLAVQSLYGKPLGGSVAVQLPGKLFTDFETWDSYSPQGRR
PETQGPKYCHSSFDAITVDRQQQLYIFKGSHFWEVAADGNVSEPRPLQERWVGLPPNIEAAAV
SLNDGDFYFFKGGRCWRFRGPKPVWGLPQLCRAGGLPRHPDAALFFPPLRRLILFKGARYYVL
ARGGLQVEPYYPRSLQDWGGIPEEVSGALPRPDGSIIFFRDDRYWRLDQAKLQATTSGRWATE
LPWMGCWHANSGSALF

Important features of the protein:
Signal peptide:
amino acids 1-22

N-glycosylation sites.
amino acids 164-168, 355-359

N-myristoylation sites.
amino acids 92-98, 153-159, 193-199, 202-208, 288-294, 368-374,
509-515

Amidation site.
amino acids 312-316

Neutral zinc metallopeptidases, zinc-binding region signature.
amino acids 237-247

Matrixins cysteine switch
amino acids 231-262, 271-284

Hemopexin domain protein
amino acids 66-108, 231-262

FIGURE 145

```
GCCGGCTAGGGCGCCGGAGCCGCACGCAGCCGCGGGGCTCCGAGAGGCGCGCACTGGGGCTGGGACTGCGCGGCG
CCGCCGCTGCGAGCGCCACTGAGCGGTCGCGCAACTTCGGAGGCACAGCGCCGGAGCCAGGCGAGCGCTCAGAGA
CCCGGAGCCAGAGGGGCGCGCCGGAGCCTCGTTCGAGAGCCGGCGCCAGGCACCCACCGCGCTCCGAGTGCCAGG
CGGCCCTCCGCGCAGCGTGGCTTCCGCTGCCCCACGGAAGGCACGGGCTGGCGCTGCCGGGCGCCGGGGAGGAC
GGCGAGGAGGAGGCGGCGGCGGCGGAGACGGCGGCGGCGAGACTGGGGCCAGGGAGACAGCCCTGGGGGAGAGGC
GCCCGAACCAGGCCGCGGGAGCATGGGGGCCCGGAGCGGAGCTCGGGGCGCGCTGCTGCTGGCACTGCTGCTCTG
CTGGGACCCGAGGCTGAGCCAAGCAGGCACTGATTCTGGCAGCGAGGTGCTCCCTGACTCCTTCCCGTCAGCGCC
AGCAGAGCCGCTGCCCTACTTCCTGCAGGAGCCACAGGACGCCTACATTGTGAAGAACAAGCCTGTGGAGCTCCG
CTGCCGCGCCTTCCCCGCCACACAGATCTACTTCAAGTGCAACGGCGAGTGGGTCAGCCAGAACGACCACGTCAC
ACAGGAAGGCCTGGATGAGGCCACCGGCCTGCGGGTGCGCGAGGTGCAGATCGAGGTGTCGCGGCAGCAGGTGGA
GGAGCTCTTTGGGCTGGAGGATTACTGGTGCCAGTGCGTGGCCTGGAGCTCCGCAGGCACCACCAAGAGTCGCCG
AGCCTACGTCCGCATCGCCTACCTGCGCAAGAACTTCGATCAGGAGCCTCTGGGCAAGGAGGTGCCCCTGGACCA
TGAGGTTCTCCTGCAGTGCCGCCCGCCGGAGGGGGTGCCTGTGGCCGAGGTGGAATGGCTCAAGAATGAGGATGT
CATCGACCCCACCCAGGACACCAACTTCCTGCTCACCATCGACCACAACCTCATCATCGCCAGGCCCGCCTGTC
GGACACTGCCAACTATACCTGCGTGGCCAAGAACATCGTGGCCAAACGCCGGAGCACCACTGCCACCGTCATCGT
CTACGTGAATGGCGGCTGGTCCAGCTGGGCAGAGTGGTCACCCTGCTCCAACCGCTGTGGCCGAGGCTGGCAGAA
GCGCACCCGGACCTGCACCAACCCCGCTCCACTCAACGGAGGGGCCTTCTGCGAGGGCCAGGCATTCCAGAAGAC
CGCCTGCACCACCATCTGCCCAGTCGATGGGCGTGGACGGAGTGGAGCAAGTGGTCAGCCTGCAGCACTGAGTG
TGCCCACTGGCGTAGCCGCGAGTGCATGGCGCCCCCACCCCAGAACGGAGGCCGTGACTGCAGCGGGACGCTGCT
CGACTCTAAGAACTGCACAGATGGGCTGTGCATGCAAAATAAGAAAACTCTAAGCGACCCCAACAGCCACCTGCT
GGAGGCCTCAGGGGATGCGGCGCTGTATGCGGGCTCGTGGTGGCCATCTTCGTGGTCGTGGCAATCCTCATGGC
GGTGGGGGTGGTGGTGTACCGCCGCAACTGCCGTGACTTCGACACAGACATCACTGACTCATCTGCTGCCCTGAC
TGGTGGTTTCCACCCCGTCAACTTTAAGACGGCAAGGCCCGTGACTGGCCGCCAGCTCCTACACCCCTCTGTGCCTCC
TGACCTGACAGCCAGCGCCGGCATCTACCGCGGACCCGTGTATGCCCTGCAGGACTCCACCGACAAAATCCCCAT
GACCAACTCTCCTCTGCTGGACCCCTTACCCAGCCTTAAGGTCAAGGTCTACAGCTCCAGCACCACGGGCTCTGG
GCCAGGCCTGGCAGATGGGGCTGACCTGCTGGGGGTCTTGCCGCCTGGCACATACCCTAGCGATTTCGCCCGGGA
CACCCACTTCCTGCACCTGCGCAGCGCCAGCCTCGGTTCCCAGCAGCTCTTGGGCCTGCCCCGAGACCCAGGGAG
CAGCGTCAGCGGCACCTTTGGCTGCCTGGGTGGGAGGCTCAGCATCCCCGGCACAGGGGTCAGCTTGCTGGTGCC
CAATGGAGCCATTCCCCAGGGCAAGTTCTACGAGATGTATCTACTCATCAACAAGGCAGAAAGTACCCTCCCGCT
TTCAGAAGGGACCCAGACAGTATTGAGCCCCTCGGTGACCTGTGGACCCACAGGCCTCCTGCTGTGCCGCCCCGT
CATCCTCACCATGCCCCACTGTGCCGAAGTCAGTGCCCGTGACTGGATCTTTCAGCTCAAGACCCAGGCCCACCA
GGGCCACTGGGAGGAGGTGGTGACCCTGGATGAGGAGACCCTGAACACACCCTGCTACTGCCAGCTGGAGCCAG
GGCCTGTCACATCCTGCTGGACCAGCTGGGCACCTACGTGTTCACGGGCGAGTCCTATTCCCGCTCAGCAGTCAA
GCGGCTCCAGCTGGCCGTCTTCGCCCCCGCCCTCTGCACCTCCCTGGAGTACAGCCTCCGGGTCTACTGCCTGGA
GGACACGCCTGTAGCACTGAAGGAGGTGCTGGAGCTGGAGCGGACTCTGGGCGGATACTTGGTGGAGGAGCCGAA
ACCGCTAATGTTCAAGGACAGTTACCACAACCTGCGCCTCTCCCTCCATGACCTCCCCCATGCCCATTGGAGGAG
CAAGCTGCTGGCCAAATACCAGGAGATCCCCTTCTATCACATTTGGAGTGGCAGCCAGAAGGCCCTCCACTGCAC
TTTCACCCTGGAGAGGCACAGCTTGGCCTCCACAGAGCTCACCTGCAAGATCTGCGTGCGGCAAGTGGAAGGGA
GGGCCAGATATTCCAGCTGCATACCACTCTGGCAGAGACACCTGCTGGCTCCCTGGACACTCTCTGCTCTGCCCC
TGGCAGCACTGTCACCACCCAGCTGGGACCTTATGCCTTCAAGATCCCACTGTCCATCCGCCAGAAGATATGCAA
CAGCCTAGATGCCCCAACTCACGGGGCAATGACTGGCGGATGTTAGCACAGAAGCTCTCTATGGACCGGTACCT
GAATTACTTTGCCACCAAAGCGAGCCCCACGGGTGTGATCCTGGACCTCTGGGAAGCTCTGCAGCAGGACGATGG
GGACCTCAACAGCCTGGCGAGTGCCTTGGAGGAGATGGGCAAGAGTGAGATGCTGGTGGCTGTGGCCACCGACGG
GGACTGCTGAGCCTCCTGGGACAGCGGGCTGGCAGGGACTGGCAGGAGGCAGGTGCAGGGAGGCCTGGGGCAGCC
TCCTGATGGGGATGTTTGGCCTCTGCTTCCTCCCAGTTCACAGCCAGAGTTGCCTCTCCTCCTCCTCTTCCCCAA
CCCCCAGACCATGACCAGCCTTAGAAAATCCATGTACTCTGTTGTTAGAGGGCCCAGAGTTCCTTCTCCACCCCC
GCTCTCTCTCTCTTGGCCTGAGATCTCTGTGCAGGAACCAAGATGGGGCTGAAGCCTCTGGAGGCAGTTGGTTGG
GGGCGGGCAGGCAGGAGGCCCTCCCTCCACCCCCCCACCCTCAGCCCGGCAACTTCTGGGTTCCGTGGGTTTTAG
TTCCGTTCTTCGTTTTCTTCCTCCGTTATTGATTTCTCCTTTCTCCCTAAGCCCCCTTCTGCTTCCACGCCCTTT
TCCTCTTTGAAGAGTCAAGTACAATTCAGACAAACTGCTTTCTCCGTCCAAAAGCAAAAAGGCAAAGGAAAGAA
AGAAAGCTTCAGACCGCTAGTAAGGCTCAAAGAAGAAGAAAAAACACCAAAACCACAAGGGAAAAGAAAAACCCAG
TTTCTTAGGAAACGCAAACGATTTATTATCCAGATTATTTGGATAAGTCCTTTTTAAAA
```

FIGURE 146

```
MGARSGARGALLLALLLCWDPRLSQAGTDSGSEVLPDSFPSAPAEPLPYFLQEPQDAYIVKNK
PVELRCRAFPATQIYFKCNGEWVSQNDHVTQEGLDEATGLRVREVQIEVSRQQVEELFGLEDY
WCQCVAWSSAGTTKSRRAYVRIAYLRKNFDQEPLGKEVPLDHEVLLQCRPPEGVPVAEVEWLK
NEDVIDPTQDTNFLLTIDHNLIIRQARLSDTANYTCVAKNIVAKRRSTTATVIVYVNGGWSSW
AEWSPCSNRCGRGWQKRTRTCTNPAPLNGGAFCEGQAFQKTACTTICPVDGAWTEWSKWSACS
TECAHWRSRECMAPPPQNGGRDCSGTLLDSKNCTDGLCMQNKKTLSDPNSHLLEASGDAALYA
GLVVAIFVVVAILMAVGVVVYRRNCRDFDTDITDSSAALTGGFHPVNFKTARPSNPQLLHPSV
PPDLTASAGIYRGPVYALQDSTDKIPMTNSPLLDPLPSLKVKVYSSSTTGSGPGLADGADLLG
VLPPGTYPSDFARDTHFLHLRSASLGSQQLLGLPRDPGSSVSGTFGCLGGRLSIPGTGVSLLV
PNGAIPQGKFYEMYLLINKAESTLPLSEGTQTVLSPSVTCGPTGLLLCRPVILTMPHCAEVSA
RDWIFQLKTQAHQGHWEEVVTLDEETLNTPCYCQLEPRACHILLDQLGTYVFTGESYSRSAVK
RLQLAVFAPALCTSLEYSLRVYCLEDTPVALKEVLELERTLGGYLVEEPKPLMFKDSYHNLRL
SLHDLPHAHWRSKLLAKYQEIPFYHIWSGSQKALHCTFTLERHSLASTELTCKICVRQVEGEG
QIFQLHTTLAETPAGSLDTLCSAPGSTVTTQLGPYAFKIPLSIRQKICNSLDAPNSRGNDWRM
LAQKLSMDRYLNYFATKASPTGVILDLWEALQQDDGDLNSLASALEEMGKSEMLVAVATGDC
```

Important features of the protein:

Signal peptide:

amino acids 1-26

Transmembrane domain:

amino acids 374-395

N-glycosylation sites.

amino acids 222-225, 347-350

Glycosaminoglycan attachment site.

amino acids 492-495 cAMP- and cGMP-dependent protein kinase phosphorylation site.

amino acids 233-236, 234-237

Casein kinase II phosphorylation sites.

amino acids 30-33, 87-90, 251-254, 341-344, 359-362, 629-632, 651-654, 706-709, 757-760, 827-830, 925-928, 941-944

Tyrosine kinase phosphorylation sites.

amino acids 216-223, 773-780

N-myristoylation sites.

amino acids 2-7, 6-11, 27-32, 96-101, 137-142, 179-184, 247-252, 281-286, 334-339, 379-384, 491-496, 495-500, 509-514, 542-547, 547-552, 550-555, 553-558, 560-565, 611-616, 785-790, 834-839, 844-849

Prokaryotic membrane lipoprotein lipid attachment site.

amino acids 541-551

ATP/GTP-binding site motif A (P-loop).

amino acids 926-933

Growth factor and cytokines receptors family signature 2.

amino acids 306-312

FIGURE 147

```
GAGAGGGACAGAGGCTGGAGAAGGATGTATGGCCTGCCCTGGGCTTGTCTGTTCCCTCCTGAGCCTGAGCCCCTT
ACCTTCCTGACCCCATGAAGCACACACTGGCTCTGCTGGCTCCCCTGCTGGGCCTGGGCCTGGGGCTGGCCCTGA
GTCAGCTGGCTGCAGGGGCCACAGACTGCAAGTTCCTTGGCCCGGCAGAGCACCTGACATTCACCCCAGCAGCCA
GGGCCCGGTGGCTGGCCCCTCGAGTTCGTGCGCCAGGACTCCTGGACTCCCTCTATGGCACCGTGCGCCGCTTCC
TCTCGGTGGTGCAGCTCAATCCTTTCCCTTCAGAGTTGGTAAAGGCCCTACTGAATGAGCTGGCCTCCGTGAAGG
TGAATGAGGTGGTGCGGTACGAGGCGGGCTACGTGGTATGCGCGTGTGATCGCGGGCCTCTACCTGCTGCTGGTGC
CCACTGCCGGGCTTTGCTTCTGCTGCTGCCGCTGCCACCGGCGCTGCGGGGGACGAGTGAAGACAGAGCACAAGG
CGCTGGCCTGTGAGCGCGCGGCCCTCATGGTCTTCCTGCTGCTGACCACCCTCTTGCTGCTGATTGGTGTGGTCT
GTGCCTTTGTCACCAACCAGCGCACGCATGAACAGATGGGCCCCAGCATCGAGGCCATGCCTGAGACCCTGCTCA
GCCTCTGGGGCCTGGTCTCTGATGTCCCCCAAGAGCTGCAGGCCGTGGCACAGCAATTCTCCCTGCCCCAGGAGC
AAGTCTCAGAGGAGCTGGATGGTGTTGGTGTGAGCATTGGGAGCGCGATCCACACTCAGCTCAGGAGCTCCGTGT
ACCCCTTGCTGGCGGCCGTGGGCAGTTTGGGCCAGGTCCTGCAGGTCTCCGTGCACCACCTGCAAACCTTGAATG
CTACAGTGGTAGAGCTGCAGGCCGGGCAGCAGGACCTGGAGCCAGCCATCCGGGAACACCGGGACCGCCTCCTTG
AGCTGCTGCAGGAGGCCAGGTGCCAGGGAGATTGTGCAGGGGCCCTGAGCTGGGCCCGCACCCTGGAGCTGGGTG
CTGACTTCAGCCAGGTGCCCTCTGTGGACCATGTCCTGCACCAGCTAAAAGGTGTCCCCGAGGCCAACTTCTCCA
GCATGGTCCAGGAGGAGAACAGCACCTTCAACGCCCTTCCAGCCCTGGCTGCCATGCAGACATCCAGCGTGGTGC
AAGAGCTGAAGAAGGCAGTGGCCCAGCAGCCGGAAGGGGTGAGGACACTGGCTGAAGGGTTCCCGGGCTTGGAGG
CAGCTTCCCGCTGGGCCCAGGCACTGCAGGAGGTGGAGGAGAGCAGCCGCCCCTACCTGCAGGAGGTGCAGAGAT
ACGAGACCTACAGGTGGATCGTGGGCTGCGTGCTGTGCTCCGTGGTCCTATTCGTGGTGCTCTGCAACCTGCTGG
GCCTCAATCTGGGCATCTGGGCCTGTCTGCCAGGGACGACCCCAGCCACCCAGAAGCCAAGGGCGAGGCTGGAG
CCCGCTTCCTCATGGCAGGTGTGGGCCTCAGCTTCCTCTTTGCTGCACCCCTCATCCTCCTGGTGTTCGCCACCT
TCCTGGTGGGTGGCAACGTGCAGACGCTGGTGTGCGCAGCGTGGGAGAACGGCGAGCTCTTTGAGTTTGCAGACA
CCCCAGGGAACCTGCCCCCGTCCATGAACCTGTCGCAACTTCTTGGCCTGAGGAAGAACATCAGCATCCACCAAG
CCTATCAGCAGTGCAAGGAAGGGGCAGCGCTCTGGACAGTCCTGCAGCTCAACGACTCCTACGACCTGGAGGAGC
ACCTGGATATCAACCAGTATACCAACAAGCTACGGCAGGAGTTGCAGAGCCTGAAAGTAGACACACAGAGCCTGG
ACCTGCTGAGCTCAGCCGCCCGCCGGGACCTGGAGGCCCTGCAGAGCAGTGGGCTTCAGCGCATCCACTACCCCG
ACTTCCTCGTTCAGATCCAGAGGCCCGTGGTGAAGACCAGCATGGAGCAGCTGGCCCAGGAGCTGCAAGGACTGG
CCCAGGCCCAAGACAATTCTGTGCTGGGGCAGCGGCTGCAGGAGGAGGCCCAAGGACTCAGAAACCTTCACCAGG
AGAAGGTCGTCCCCCAGCAGAGCCTTGTGGCAAAGCTCAACCTCAGCGTCAGGGCCCTGGAGTCCTCTGCCCCGA
ATCTCCAGCTGGAGACCTCAGATGTCCTAGCCAATGTCACCTACCTGAAAGGAGAGCTGCCTGCCTGGGCAGCCA
GGATCCTGAGGAATGTGAGTGAGTGTTTCCTGGCCCGGGAGATGGGCTACTTCTCCCAGTACGTGGCCTGGGTGA
GAGAGGAGGTGACTCAGCGCATTGCCACCTGCCAGCCCCTCTCCGGAGCCCTGGACAACAGCCGTGTGATCCTGT
GTGACATGATGGCTGACCCCTGGAATGCCTTCTGGTTCTGCCTGGCATGGTGCACCTTCTTCCTGATCCCCAGCA
TCATCTTTGCCGTCAAGACCTCCAAATACTTCCGTCCTATCCGGAAACGCCTCAGCTCCACCAGCTCTGAGGAGA
CTCAGCTCTTCCACATCCCCCGGGTTACCTCCCTGAAGCTGTAGGGCCTTGTGGGGTGAGGTGACCCTGAGGCTG
CCTGTCCTCCCCTTTGATTTAGCCTGGGCCACAGGACTTCGGTAGCTCTTGCCCCAGAGCCCAGGCTGGCATCCA
GGCCTGGACTGTCCCCAGTTCCGGCTTACCTGGCCCCACCTTGCCTGCTCCTTTCCACCCCTTTCTGCTCACGAC
CCCCATCATTCACGCTCAGAATCACATGGGACTTCTGTGCAGCTGCAGAGCCAGCAAGTCCCTACAGGTGTCACC
CGTTACCCCCATGCTGGTGGCATCCTCACAGGAAGAGCCTGTTCTCCACCTGCTGGAGCCTGGACCCTGGGGTGG
GACAGAGGCCTCGTCCAACCCCACTCCCCTTCCCGTGTGTCTTCCCCCTGCCAAGCCTCCCCCTGCCAAGCCTCC
CCCTGCCCCTCTCTGAGCCCCTCGCCCCCCACACCGTCCTCATCTGGCCTCCCCCTGGCCCCCACTTCCCTCTT
ATGCCCTTCCTGGCCCTTTGCTTCCTCCCTTAGTCCCCTCTTCACCATATCTCCACTGCTACCTTGCTGGCCCCA
GAGACCACCCTGCCCAACCAAACCACTCAGGTAACGCCACTAATCAGGCAGGGGCCACCATGGCCTAGGTCTGGG
CTGGCTGCAGGCCCTGCCTCATGGCCTCTGAGCCCTCCACTGCCCAGGGCCTTGGGCCCTCTGCAGATCTCATC
CAGGATTTATTGTTGTCCAGTGGGTGAGGGAGGCCTGTCTGAAGGCCGAGCCTCCCTGCCTGCACCCAAGTTAG
AAATGGGGGTACCAGCACTTAGCTTCTCTCTGAGTGCTGGCTCCCAAGGAAGGGACCTGGGACCTGGGCCACAGT
GGGGGCTTGCCCTTACCTCTTCAGAAGGAAGCATCTTCCACAGCCCCCACCCAACTTTCTTAGGAGTGATCTGGT
GGCCAGAACAGGATTTTGCACGGCCCCTTTTATCCTGCGCATGTGGCCTAGGGTCATCCCCAGCCCATCCCTGTG
TCAGCCCTGAGTGCTGGACACTGCGTTCCAGAAATGAGGAAGAGGAGAGAGAAGAGATGGACAGACCTCAGATCC
ATTAAAGTGTTCTCACTTCAAAAAAAAAAAAAAAAAAAAAAAAAAAAAAAAAAAAAAAA
```

FIGURE 148

```
MKHTLALLAPLLGLGLGLALSQLAAGATDCKFLGPAEHLTFTPAARARWLAPRVRAPGLL
DSLYGTVRRFLSVVQLNPFPSELVKALLNELASVKVNEVVRYEAGYVVCAVIAGLYLLLV
PTAGLCFCCCRCHRRCGGRVKTEHKALACERAALMVFLLLTTLLLLIGVVCAFVTNQRTH
EQMGPSIEAMPETLLSLWGLVSDVPQELQAVAQQFSLPQEQVSEELDGVGVSIGSAIHTQ
LRSSVYPLLAAVGSLGQVLQVSVHHLQTLNATVVELQAGQQDLEPAIREHRDRLLELLQE
ARCQGDCAGALSWARTLELGADFSQVPSVDHVLHQLKGVPEANFSSMVQEENSTFNALPA
LAAMQTSSVVQELKKAVAQQPEGVRTLAEGFPGLEAASRWAQALQEVEESSRPYLQEVQR
YETYRWIVGCVLCSVVLFVVLCNLLGLNLGIWGLSARDDPSHPEAKGEAGARTLMAGVGL
SFLFAAPLILLVFATFLVGGNVQTLVCRSWENGELFEFADTPGNLPPSMNLSQLLGLRKN
ISIHQAYQQCKEGAALWTVLQLNDSYDLEEHLDINQYTNKLRQELQSLKVDTQSLDLLSS
AARRDLEALQSSGLQRIHYPDFLVQIQRPVVKTSMEQLAQELQGLAQAQDNSVLGQRLQE
EAQGLRNLHQEKVVPQQSLVAKLNLSVRALESSAPNLQLETSDVLANVTYLKGELPAWAA
RILRNVSECFLAREMGYFSQYVAWVREEVTQRIATCQPLSGALDNSRVILCDMMADPWNA
FWFCLAWCTFFLIPSIIFAVKTSKYFRPIRKRLSSTSSEETQLFHIPRVTSLKL
```

Signal peptide:

amino acids 1-17

Transmembrane domain:

amino acids 105-125, 153-173, 428-449, 476-500, 778-797

N-glycosylation sites:

amino acids 270-273, 343-347, 352-356, 530-534, 540-546, 563-567, 684-688, 707-711, 725-729 cAMP- and cGMP-dependent protein kinase phosphorylation site.

amino acids 811-815

Tyrosine kinase phosphorylation site.

amino acids 95-103

N-myristoylation sites.

amino acids 13-19, 15-21, 17-23, 26-32, 58-64, 124-130, 168-174, 228-234, 230-236, 320-326, 338-344, 393-399, 429-435, 446-452, 477-483, 500-506, 536-542, 644-650, 761-767

Phospholipase A2 histidine active site.

aminop acids 129-137

4Fe-4S ferredoxins, iron-sulfur binding region signature.

amino acids 126-138

Mitochondrial energy transfer proteins signature.

amino acids 80-89

FIGURE 149

CACAGCTCCCTTCCCAGGACGTGAAAATCTGCCTTCTCACC<u>ATG</u>AGGCTTCTAGTCCTTTCCA
GCCTGCTCTGTATCCTGCTTCTCTGCTTCTCCATCTTCTCCACAGAAGGGAAGAGGCGTCCTG
CCAAGGCCTGGTCAGGCAGGAGAACCAGGCTCTGCTGCCACCGAGTCCCTAGCCCCAACTCAA
CAAACCTGAAAGGACATCATGTGAGGCTCTGTAAACCATGCAAGCTTGAGCCAGAGCCCCGCC
TTTGGGTGGTGCCTGGGGCACTCCCACAGGTG<u>TAG</u>CACTCCCAAAGCAAGACTCCAGACAGCG
GAGAACCTCATGCCTGGCACCTGAGGTACCCAGCAGCCTCCTGTCTCCCCTTTCAGCCTTCAC
AGCAGTGAGCTGCAATGTTGGAGGGCTTCATCTCGGGCTGCAAGGACCCTGGGAAAGTTCCAG
AACTCCACGTCCTTGTCTCAATTGTGCCATCAACTTTCAGAGCTATCATGAGCCAACCTCACC
CCACAGGGCCTCAGTCGCCACCATGTGGGCCTCTCCAGTGCAAACCACCGAGCATTCCACCAT
GACCGGTCACAGCTACAAATCCAGAGACCATCAATCCTGCTAGAGTGCAGGGTGGCAAGCACC
CAAGGGTGGCTGACCAAGACTGCAGAGTCTCCTCCATCTTCAGGTCCATTCAGCCTCCTGGCA
TTTAACTACCAGCATCCAGTGGTCCCCAAGGAATCCCTTCCTAGCCTCCTGACATGAGTCTGC
TGGAAAGAGCATCCAAACAAACAAGTAATAAATAAATAAATAAACTCA

FIGURE 150

MRLLVLSSLLCILLLCFSIFSTEGKRRPAKAWSGRRTRLCCHRVPSPNSTNLKGHHVRLCKPC
KLEPEPRLWVVPGALPQV

Important features of the protein:

Signal peptide:

amino acids 1-21

N-glycosylation site.

amino acids 48-52

Amidation sites.

amino acids 23-27, 33-37

FIGURE 151

```
CACCGGAGGGCACGCAGCTGACGGAGCTGCGCTGCGTTCGCCTCGTTTGCCTCGCGCCCTCCA
CTGGAGCTGTTCGCGCCTCCCGGCTCCCACCGCAGCCCACCCGGCAGAGGAGTCGCTACCAGC
GCCCAGTGCGCTCTGTCAGTCCGCAAACTCCTTGCCGCCCGCCCCGGGCTGGGCACCAAATAC
CAGGCTACCATGGTCTACAAGACTCTCTTCGCTCTTTGCATCTTAACTGCAGGATGGAGGGTA
CAGAGTCTGCCTACATCAGCTCCTTTGTCTGTTTCTCTTCCGACAAACATTGTACCACCGACC
ACCATCTGGACTAGCTCTCCACAAAACACTGATGCAGACACTGCCTCCCCATCCAACGGCACT
CACAACAACTCGGTGCTCCCAGTTACAGCATCAGCCCCAACATCTCTGCTTCCTAAGAACATT
TCCATAGAGTCCAGAGAAGAGGAGATCACCAGCCCAGGTTCGAATTGGGAAGGCACAAACACA
GACCCCTCACCTTCTGGGTTCTCGTCAACAAGCGGTGGAGTCCACTTAACAACCACGTTGGAG
GAACACAGCTCGGGCACTCCTGAAGCAGGCGTGGCAGCTACACTGTCGCAGTCCGCTGCTGAG
CCTCCCACACTCATCTCCCCTCAAGCTCCAGCCTCATCACCCTCATCCCTATCAACCTCACCA
CCTGAGGTCTTTTCTGCCTCCGTTACTACCAACCATAGCTCCACTGTGACCAGCACCCAACCC
ACTGGAGCTCCAACTGCACCAGAGTCCCCGACAGAGGAGTCCAGCTCTGACCACACACCCACT
TCACATGCCACAGCTGAGCCAGTGCCCCAGGAGAAAACACCCCAACAACTGTGTCAGGCAAA
GTGATGTGTGAGCTCATAGACATGGAGACCACCACCACCTTTCCCAGGGTGATCATGCAGGAA
GTAGAACATGCATTAAGTTCAGGCAGCATCGCCGCCATTACCGTGACAGTCATTGCCGTGGTG
CTGCTGGTGTTTGGAGTTGCAGCCTACCTAAAAATCAGGCATTCCTCCTATGGAAGACTTTTG
GACGACCATGACTACGGGTCCTGGGGAAACTACAACAACCCTCTGTACGATGACTCCTAACAA
TGGAATATGGCCTGGGATGAGGATTAACTGTTCTTTATTTATAAGTGCTTATCCAGTAGAATT
AATAAGTACCTGATGCGCATTGAACGACAATCTTAAGCCCTGTTTTGTTGGTATGGTTGTTTT
TGTTTTCCTCCCTCTCCTCTGGCTGCTACAACTTCCCCTTTCTGGTACAAGAAGAACCATTCT
TTAAAGGTGAGTGGAGGCTGATTTGCAGCTGAAGTGGGCCAGCCTTGCACCAGCCAGGCCAGA
CCACCATGGTGAAGGCTTCTTTCCCCACTGCAGGACCCACTTTGAGAAGGATCGAGGAGGAGG
ATTTGGGTTGTTTTGTTAGGGGTTACTTTCAGGGGAACATTTCATTTGTGTTATTTCTTAAAC
TTCTATTTAGGAAATTACATTAAGTATTAATGAGGGGAAAGGAAATGAGCTCTACGAGGATTT
CACCTTGCATGGGAGAGAGCAGGGTTTTCTCAGATTCCTTTTTAATCTCTATTTATCTGGTTG
TTTCTGACAGGATGCTGCCTGCTTGGCTCTACGAGCTGGAAAGCAGCTTCTTAGCTGCCTAAT
TAATGAAAGATGAAAATAGGAAGTGCCCTGGAGGGGCCAGCAGGTCACGGGCAGAATCTCT
CAGGTTGCTGTGGGATCTCAGTGTGCCCCTACCTGTTCTCCCCTCCAGGCCACCTGTCTCTGT
AAAGGATGTCTGCTCTGTTCAAAAGGCAGCTGGGATCCCAGCCCACAAGTGATCAGCAGAGTT
GCATTTCCAAAGAAAAGGCTATGAGATGAGCTGAGTTATAGAGAGAAAGGGAGAGGCATGTA
CGGTGTGGGGAAGTGGAAGAGAAGCTGGCGGGGAGAAGGAGGCTAACCTGCACTGAGTACTT
CATTAGGACAAGTGAGAATCAGCTATTGATAATGGCCAGAGATATCCACAGCTTGGAGGAGCC
CAGAGACTGTTTGCTTTATACCCACACAGCAACTGGTCCACTGCTTTACTGTCTGTTGGATAA
TGGCTGTAAAATGTTTAAAAAC
```

FIGURE 152

MVYKTLFALCILTAGWRVQSLPTSAPLSVSLPTNIVPPTTIWTSSPQNTDADTASPSNGTHNN
SVLPVTASAPTSLLPKNISIESREEEITSPGSNWEGTNTDPSPSGFSSTSGGVHLTTTLEEHS
SGTPEAGVAATLSQSAAEPPTLISPQAPASSPSSLSTSPPEVFSASVTTNHSSTVTSTQPTGA
PTAPESPTEESSSDHTPTSHATAEPVPQEKTPPTTVSGKVMCELIDMETTTTFPRVIMQEVEH
ALSSGSIAAITVTVIAVVLLVFGVAAYLKIRHSSYGRLLDDHDYGSWGNYNNPLYDDS

Important features of the protein:

Signal peptide:
amino acids 1-20

Transmembrane domain:
amino acids 258-278

N-glycosylation sites.
amino acids 58-61, 62-65, 80-83, 176-179

Casein kinase II phosphorylation sites.
amino acids 49-52, 85-88, 95-98, 100-103, 120-123, 121-124, 141-144, 164-167, 191-194, 195-198, 200-203

Tyrosine kinase phosphorylation site.
amino acids 289-296

N-myristoylation sites.
amino acids 59-64, 115-120, 128-133, 133-138, 257-262, 297-302

FIGURE 153

ACGTCACTGTCTTGAAGCAGCAGTAGCCTGGGAAGTGAGGCAGGAGGAATTGAGAGGCAGGAA
GGGNGCTGGAGACACAGCTGAGCCTGGAAATGAGAGTGGGCATCGCCGTGGTCATCATGACTC
CTCTGCGGCGTGGTCACCATGTTGGTTCACTGTGTTGGGCTCTTATTGACGGGTCTCCTGCTA
GGCCTGACCTTGGGTGCCGGAGCCCTGCTGGCTTCTGAGCCTATCTACCAACCACCTTCAGCC
TGGGTGCCAGCTGGGGGCTGGTGGGCTGGCGCTGCTGGGAGCCCTGCTCACACTTCGGTGG
CCACGTCCATTCACAGTTCTGGGCACAACCCTGCTGGGTTCTGCAGTGCTTGTGGCCTGTGTT
GACTACTTCCTGGAGGGGCTGGCACTGGGGAGTTGGCTGGCCAACGCCTGCAGACACTTCCA
GCCTTGCCTTCTCTCTGCTGATATAGCTGGGTCTTACTGGGGATCTGGCCAGCCTTGGGGGCC
CTTGGAGCCCTGGCCCAGTGGAAGCTCGTGCCTGAGGAACATGGAGGCCACGCTAATGGGTCT
GTTCCTGGTTTCCCAGATGCATAAAGGAAGACATATCCCTCCCCTGGGCAGCAAGGCTACAAT
GGGAGGGAGGGAGAACATGGAGCATGTGAATAAAATGGCATTAAATACTGAAAAAAAAAAA
AAAAAAAAAAAAAAAAAAAAAAAAAAAAAAAAAAAAAAAAAAAAAAAAAAAAAAAAAA

FIGURE 154

MLVHCVGLLLTGLLLGLTLGAGALLASEPIYQPPSAWVPAGGLVGLALLGALLTLRWPRPFTV
LGTTLLGSAVLVACVDYFLEGLALGSWLGQRLQTLPALPSLC

Signal peptide:

amino acids 1-20

Transmembrane domain:

amino acids 38-55, 60-78

N-myristoylation sites.

amino acids 7-13, 12-18, 16-22, 22-28, 41-47, 50-56, 84-90, 88-94

Prokaryotic membrane lipoprotein lipid attachment site.

amino acids 67-78

FIGURE 155

```
TGCAATTAAAGGAGTCGGGTCTCTAACTGTTGATCTGTTTTTTTCCCTTCTGAGCAATGGAGC
TTACCATCTTTATCCTGAGACTGGCCATTTACATCCTGACATTTCCCTTGTACCTGCTGAACT
TTCTGGGCTTGTGGAGCTGGATATGCAAAAAATGGTTCCCCTACTTCTTGGTGAGGTTCACTG
TGATATACAACGAACAGATGGCAAGCAAGAAGCGGGAGCTCTTCAGTAACCTGCAGGAGTTTG
CGGGCCCCTCCGGGAAACTCTCCCTGCTGGAAGTGGGCTGTGGCACGGGGCCAACTTCAAGT
TCTACCCACCTGGGTGCAGGGTGACCTGTATTGACCCCAACCCCAACTTTGAGAAGTTTTGA
TCAAGAGCATTGCAGAGAACCGACACCTGCAGTTTGAGCGCTTTGTGGTAGCTGCCGGGGAGA
ACATGCACCAGGTGGCTGATGGCTCTGTGGATGTGGTGGTCTGCACCCTGGTGCTGTGCTCTG
TGAAGAACCAGGAGCGGATTCTCCGCGAGGTGTGCAGAGTGCTGAGACCGGGAGGGCTTTCT
ATTTCATGGAGCATGTGGCAGCTGAGTGTTCGACTTGGAATTACTTCTGGCAACAAGTCCTGG
ATCCTGCCTGGCACCTTCTGTTTGATGGGTGCAACCTGACCAGAGAGAGCTGGAAGGCCCTGG
AGCGGGCCAGCTTCTCTAAGCTGAAGCTGCAGCACATCCAGGCCCCACTGTCCTGGGAGTTGG
TGCGCCCTCATATCTATGGATATGCTGTGAAATAGTGTGAGCTGGCAGTTAAGAGCTGAATGG
CTCAAAGAATTTAAAGCTTCAGTTTTACATTTAAAATGCTAAGTGGGAGAAGAGAAACCTTTT
TTTTGGGGGGCGGTTTTTTTGGTTTGTTGTTGGTTTTTTTTTTTTTTTGGCAGGAGAATCTC
TTGAACCCAGAAGGCGAAGGTTGCAGTGAACCGAGATCATGCCATTGTACTCTAGCCTGGGTG
ACAAGAGCAAGACTCCGTCTCAAAAAAAAAAAAAAAAAAAAAAAAGAAGTAGAGACAGGGAGAC
GGGGTCTCACTGTGTTGCCTAGGCCGGTCTTGAACTCCTGGGCTCAAGTGATTCTCCCACCTT
GACCTCCTAAATTGTTGGGATTACAGGTGTGAGACAGTGCACCTGGCCGAAATAGCTCAAGTT
TCTGAAAAACAAATCTGAATCTATTTGTTATTCTTAGCGTCACTGGTCTGGCTTTCAGAATTA
ACATACAAGGTTGCCACACCTAGTTCTGCCCAGCTTTATGTCTTTTATTCCAGTATTCCACCA
AAGTTTGTTTTCCTGCATTCCAGTTCTCAAGTCTTAAGATAAAGATTGTACTTGACAGTTTAG
TATATCCATAAAACTATTTGAGGTGGTTAAGGTTCTTGGGTTCATTTTCCTTAATACTTTGCT
GAATATTGTAGATTGTAGGCAATGAAAAGTCTACTAAATTAGGAAACCTTGAATAATTAGG
TATCCTAGGTAAGAGCCCCTAAACATCAAGCAATCTGTGAGTCTGTAAAGAAATAAATATTTT
TTGGATTATTCTTATCTAATTCCACCCCTGTTGGAAGATGATTTCTTTGTTCTTTGCAACTAT
GGAAGCTGTGAAAATCATCACAAGTGCCTCTGAAAGCGAGTGTTAGGTTGGTTAGAGGGTTTA
ATATTTTCTGCAATGGTTTGTAGGAATTTTAATAAATGTAGTATATTTTCTGAGATGATTTTG
TAAAAGTACTATTTTAAATATCAAATCAACCAATAAATTCACATTTGTGTTAGGAACAAAA
```

FIGURE 156

MELTIFILRLAIYILTFPLYLLNFLGLWSWICKKWFPYFLVRFTVIYNEQMASKKRELFSNLQ
EFAGPSGKLSLLEVGCGTGANFKFYPPGCRVTCIDPNPNFEKFLIKSIAENRHLQFERFVVAA
GENMHQVADGSVDVVVCTLVLCSVKNQERILREVCRVLRPGGAFYFMEHVAAECSTWNYFWQQ
VLDPAWHLLFDGCNLTRESWKALERASFSKLKLQHIQAPLSWELVRPHIYGYAVK

Signal peptide:
amino acids 1-29

N-glycosylation site.
amino acids 203-207

N-myristoylation sites.
amino acids 78-84, 80-86, 91-97, 201-207

FIGURE 157

CCGCTGAGATGTACGAACTTCCGGTTCTCCGGGCAGCTGCCACTGCTGTAGCTTCTGCCACCT
GCCACGACCGGGCCTCTCCCTGGCGTTTGGTCACCTCTGCTTCATTCTCCACCGCGCCTATGG
TCCCTCTTGGAGCCAGCGTGGCGGGCCTGGCGGCTCCCGGGTGGTGAGAGAGCGGTCCGGGAA
CGATGAAGGCCTCGCAGTGCTGCTGCTGTCTCAGCCACCTCTTGGCTTCCGTCCTCCTCCTGC
TGTTGCTGCCTGAACTAAGCGGGCCCCTGGCAGTCCTGCTGCAGGCAGCCGAGGCCGCGCCAG
GTCTTGGGCCTCCTGACCCTAGACCACGGACATTACCGCCGCTGCCACCGGGCCCTACCCCTG
CCCAGCAGCCGGGCCGTGGTCTGGCTGAAGCTGCGGGCCGCGGGGCTCCGAGGGAGGCAATG
GCAGCAACCCTGTGGCCGGGCTTGAGACGGACGATCACGGAGGGAAGGCCGGGGAAGGCTCGG
TGGGTGGCGGCCTTGCTGTGAGCCCCAACCCTGGCGACAAGCCCATGACCCAGCGGGCCCTGA
CCGTGTTGATGGTGGTGAGCGGCGCGGTGCTGGTGTACTTCGTGGTCAGGACGGTCAGGATGA
GAAGAAGAAACCGAAAGACTAGGAGATATGGAGTTTTGGACACTAACATAGAAAATATGGAAT
TGACACCTTTAGAACAGGATGATGAGGATGATGACAACACGTTGTTTGATGCCAATCATCCTC
GAAGATAAGAATGTGCCTTTTGATGAAAGAACTTTATCTTTCTACAATGAAGAGTGGAATTTC
TATGTTTAAGGAATAAGAAGCCACTATATCAATGTTGGGGGGTATTTAAGTTACATATATTT
TAACAACCTTTAATTTGCTGTTGCAATAAATACCGTATCCTTTTATTATATCTTTATATGTAT
AGAAGTACTCTATTAATGGGCTCAGAGATGTTGGGGATAAAGTATACTGTAATAATTTATCTG
TTTGAAAATTACTATAAAACGGTGTTTTCTGGTCGGTTTTTGTTTCCTGCTTACCATATGATT
GTAAATTGTTTTATGTATTAATCAGTTAATGCTAATTATTTTTGCTGATGTCATATGTTAAAG
AGCTATAAATTCCAACAACCAACTGGTGTGTAAAAATAATTTAAAATTTCCTTTACTGAAAGG
TATTTCCCATTTTTGTGGGGAAAAGAAGCCAAATTTATTACTTTGTGTTGGGGTTTTTAAAAT
ATTAAGAAATGTCTAAGTTATTGTTTGCAAAACAATAAATATGATTTTAAATTCTCTTAAAAA
AAAAA

FIGURE 158

MKASQCCCCLSHLLASVLLLLLLPELSGPLAVLLQAAEAAPGLGPPDPRPRTLPPLPPGPTPA
QQPGRGLAEAAGPRGSEGGNGSNPVAGLETDDHGGKAGEGSVGGGLAVSPNPGDKPMTQRALT
VLMVVSGAVLVYFVVRTVRMRRRNRKTRRYGVLDTNIENMELTPLEQDDEDDDNTLFDANHPRR

Signal peptide:
amino acids 1-28

Transmembrane domain:
amino acids 124-140

N-glycosylation site.
amino acids 83-87

N-myristoylation sites.
amino acids 69-75, 78-84, 81-87, 97-103, 103-109, 106-112, 157-160

FIGURE 159

```
GCTGCAGGCGGCGACGGCTACACCATGGGCCGGCTGCTGCGGGCCGCCCGGCTGCCGCCGCTG
CTTTCGCCGCTGCTGCTTCTGCTGGTTGGGGGAGCGTTCCTGGGTGCCTGTGTGGCTGGGTCT
GATGAGCCTGGCCCAGAGGGCCTCACCTCCACCTCCCTGCTAGACCTCCTGCTGCCCACTGGC
TTGGAGCCACTGGACTCAGAGGAGCCTAGTGAGACCATGGGCCTGGGAGCTGGGCTGGGAGCC
TCTGGCTCAGGCTTCCCCAGCGAAGAGAATGAAGAGTCTCGGATTCTGCAGCCACCACAGTAC
TTCTGGGAAGAGGAGGAAGAGCTGAATGACTCAAGTCTGGACCTGGGACCCACTGCAGATTAT
GTTTTTCCTGACTTAACTGAGAAGGCAGGTTCCATTGAAGACACTAGCCAGGCTCAAGAGCTG
CCAAACCTCCCCTCTCCCTTGCCCAAGATGAATCTGGTTGAGCCTCCCTGGCATATGCCTCCC
AGAGAGGAGGAAGAAGAGGAAGAGGAAGAGGAGGAGAGGGAGAAGGAAGAGGTAGAGAAACAA
GAGGAGGAGGAAGAGGAGGAGCTGCTCCCTGTGAATGGATCCCAAGAAGAAGCCAAGCCTCAG
GTCCGTGACTTTTCTCTCACCAGCAGCAGCCAGACCCCAGGGGCCACCAAAAGCAGGCATGAA
GACTCCGGGGACCAGGCCTCATCAGGTGTGGAGGTGGAGAGCAGCATGGGGCCCAGCTTGCTG
CTGCCTTCAGTCACCCCAACTACAGTGACTCCGGGGGACCAGGACTCCACCAGCCAAGAGGCA
GAGGCCACAGTGCTGCCAGCTGCAGGGCTTGGGGTAGAGTTCGAGGCTCCTCAGGAAGCAAGC
GAGGAAGCCACTGCAGGAGCAGCTGGTTTGTCTGGCCAGCACGAGGAGGTGCCGGCCTTGCCT
TCATTCCCTCAAACCACAGCTCCCAGTGGGGCCGAGCACCCAGATGAAGATCCCCTTGGCTCT
AGAACCTCAGCCTCTTCCCCACTGGCCCCTGGAGACATGGAACTGACACCTTCCTCTGCTACC
TTGGGACAAGAAGATCTCAACCAGCAGCTCCTAGAAGGGCAGGCAGCTGAAGCTCAATCCAGG
ATACCCTGGGATTCTACGCAGGTGATCTGCAAGGACTGGAGCAATCTGGCTGGGAAAAACTAC
ATCATTCTGAACATGACAGAGAACATAGACTGTGAGGTGTTCCGGCAGCACCGGGGCCACAG
CTCCTGGCCCTGGTGGAAGAGGTGCTGCCCCGCCATGGCAGTGGCCACCATGGGGCCTGGCAC
ATCTCTCTGAGCAAGCCCAGCGAGAAGGAGCAGCACCTTCTCATGACACTGGTGGGCGAGCAG
GGGGTGGTGCCCACTCAAGATGTCCTTTCATGCTGGGTGACATCCGCAGGAGCCTGGAGGAG
ATTGGCATCCAGAACTATTCCACAACCAGCAGCTGCCAGGCGCGGGCCAGCCAGGTGCGCAGC
GACTACGGCACGCTCTTCGTGGTGCTGGTGGTCATTGGGGCCATCTGCATCATCATCATTGCG
CTTGGCCTGCTCTACAACTGCTGGCAGCGCCGGCTGCCCAAGCTCAAGCACGTGTCGCACGGC
GAGGAGCTGCGCTTCGTGGAGAACGGCTGCCACGACAACCCCACGCTGGACGTGGCCAGCGAC
AGCCAGTCGGAGATGCAGGAGAAGCACCCCAGCCTGAACGGCGGCGGGGCCCTCAACGGCCCG
GGGAGCTGGGGGCGCTCATGGGGGCAAGCGGGACCCCGAGGACTCGGACGTGTTCGAGGAG
GACACGCACCTGTGAGCGCAGCCGAGGCGCAGGCCGAGTGGGCCGCCAGGACCAAGCGAGGTG
GACCCCGAAACGGACGGCCCGGAGCCCGCACCAGCCCCGCGCCTACCCGGGCCGCCCCGCGG
CCTGGCCCTCGGCGCGGGCTCCTTCCCGCTTCCCCCGACTTCACACGGCGGCTTCGGACCAAC
TCCCTCACTCCCGCCCGAGGGGCAGGCCTCAAAGCCCGCCTTGGCCCCGCTTTCCCGCCCCTG
AACCCCGGCCCCGCGGGCGGCGGCGGCGCTTCCTGCGCCCCGGGACTCAATTAAACCCGCCC
GGAGACCACGCCGGGCCCAGCAAAA
```

FIGURE 160

```
MGRLLRAARLPPLLSPLLLLLVGGAFLGACVAGSDEPGPEGLTSTSLLDLLLPTGLEPLDSEE
PSETMGLGAGLGASGSGFPSEENEESRILQPPQYFWEEEEELNDSSLDLGPTADYVFPDLTEK
AGSIEDTSQAQELPNLPSPLPKMNLVEPPWHMPPREEEEEEEEEEEREKEEVEKQEEEEEEL
LPVNGSQEEAKPQVRDFSLTSSSQTPGATKSRHEDSGDQASSGVEVESSMGPSLLLPSVTPTT
VTPGDQDSTSQEAEATVLPAAGLGVEFEAPQEASEEATAGAAGLSGQHEEVPALPSFPQTTAP
SGAEHPDEDPLGSRTSASSPLAPGDMELTPSSATLGQEDLNQQLLEGQAAEAQSRIPWDSTQV
ICKDWSNLAGKNYIILNMTENIDCEVFRQHRGPQLLALVEEVLPRHGSGHHGAWHISLSKPSE
KEQHLLMTLVGEQGVVPTQDVLSMLGDIRRSLEEIGIQNYSTTSSCQARASQVRSDYGTLFVV
LVVIGAICIIIIALGLLYNCWQRRLPKLKHVSHGEELRFVENGCHDNPTLDVASDSQSEMQEK
HPSLNGGGALNGPGSWGALMGGKRDPEDSDVFEEDTHL
```

Signal peptide:
amino acids 1-29

Transmembrane domain:
amino acids 499-521

N-glycosylation sites.
amino acids 106-110, 193-197, 395-399, 480-484

Glycosaminoglycan attachment site.
amino acids 77-81

N-myristoylation sites.
amino acids 24-30, 28-34, 41-47, 69-75, 71-77, 73-79, 75-81,
216-222, 327-333, 455-461, 519-525, 574-580, 581-587, 584-590

Amidation site.
amino acids 588-592

FIGURE 161

CCAGGGCGGAGCGCAGCTGCGCCGGGCTTGGGCGCCTGGGGCCGCCGCTCCCCACCGTCGTTT
TCCCCACCGAGGCCGAGGCGTCCCGGAGTC<u>AT</u>GGCCGGCCTGAACTGCGGGGTCTCTATCGCA
CTGCTAGGGGTTCTGCTGCTGGGTGCGGCGCGCCTGCCGCGCGGGGCAGAAGCTTTTGAGATT
GCTCTGCCACGAGAAAGCAACATTACAGTTCTCATAAAGCTGGGGACCCCGACTCTGCTGGCA
AAACCCTGTTACATCGTCATTTCTAAAAGACATATAACCATGTTGTCCATCAAGTCTGGAGAA
AGAATAGTCTTTACCTTTAGCTGCCAGAGTCCTGAGAATCACTTTGTCATAGAGATCCAGAAA
AATATTGACTGTATGTCAGGCCCATGTCCTTTTGGGGAGGTTCAGCTTCAGCCCTCGACATCG
TTGTTGCCTACCCTCAACAGAACTTTCATCTGGGATGTCAAAGCTCATAAGAGCATCGGTTTA
GAGCTGCAGTTTTCCATCCCTCGCCTGAGGCAGATCGGTCCGGGTGAGAGCTGCCCAGACGGA
GTCACTCACTCCATCAGCGGCCGAATCGATGCCACCGTGGTCAGGATCGGAACCTTCTGCAGC
AATGGCACTGTGTCCCGGATCAAGATGCAAGAAGGAGTGAAAATGGCCTTACACCTCCCATGG
TTCCACCCCAGAAATGTCTCCGGCTTCAGCATTGCAAACCGCTCATCTATAAACGTCTGTGC
ATCATCGAGTCTGTGTTTGAGGGTGAAGGCTCAGCAACCCTGATGTCTGCCAACTACCCAGAA
GGCTTCCCTGAGGATGAGCTCATGACGTGGCAGTTTGTCGTTCCTGCACACCTGCGGGCCAGC
GTCTCCTTCCTCAACTTCAACCTCTCCAACTGTGAGAGGAAGGAGGAGCGGGTTGAATACTAC
ATCCCGGGCTCCACCACCAACCCCGAGGTGTTCAAGCTGGAGGACAAGCAGCCTGGGAACATG
GCGGGGAACTTCAACCTCTCTCTGCAAGGCTGTGACCAAGATGCCCAAAGTCCAGGGATCCTC
CGGCTGCAGTTCCAAGTTTTGGTCCAACATCCACAAAATGAAAGCAGTGAG<u>TGA</u>GCCCCACTT
TCCTTTTTCTTCCTCCAGCACCTTCGTTGTTTCCTGGGTAGTCTGCCTGGGTGAGGCTCC
CTTCCTGTTTCTCATCTGTGGCTTCTGAAACACTTAGACTCTGGACCCAGCAAGAGTTTCAGG
AAGTGGGTTGCTAGGCAGTTAGACAGGCTTGTTGGTGAACACCCGGTATGTAGTTCCATTTCA
GCACAATAAAAGAAATCTTGCATTCAAGATGCTAAATTGTTTTTAACGAAAA

FIGURE 162

MAGLNCGVSIALLGVLLLGAARLPRGAEAFEIALPRESNITVLIKLGTPTLLAKPCYIVISKR
HITMLSIKSGERIVFTFSCQSPENHFVIEIQKNIDCMSGPCPFGEVQLQPSTSLLPTLNRTFI
WDVKAHKSIGLELQFSIPRLRQIGPGESCPDGVTHSISGRIDATVVRIGTFCSNGTVSRIKMQ
EGVKMALHLPWFHPRNVSGFSIANRSSIKRLCIIESVFEGEGSATLMSANYPEGFPEDELMTW
QFVVPAHLRASVSFLNFNLSNCERKEERVEYYIPGSTTNPEVFKLEDKQPGNMAGNFNLSLQG
CDQDAQSPGILRLQFQVLVQHPQNESSE

Signal peptide:
amino acids 1-29

N-glycosylation sites.
amino acids 39-43, 122-126, 180-184, 205-209, 213-217, 270-274, 310-314, 339-343

Tyrosine kinase phosphorylation site.
amino acids 276-284

N-myristoylation sites.
amino acids 3-9, 7-13, 158-164, 175-181, 191-197, 303-309

FIGURE 163

```
CAACCACACACCTGGGGAATTGCTGGCCTGACTTCTGACCCCTGACTCCTCATACCCTTCCTC
CAGAGCATGACATTTGACCACCAACTGAAACCTGACCTCTGACCCCAGACCACTGGCCCTTCC
CCCGCCCTGTGGTGACTTCATAAAGGTTACTAGCTTCTCCCCTGGCCTTGAGACCCACACGAT
GGCCCTGCTGGCTCTGGCCAGTGCCGTCCCTCTGCCCTGCTGGCCCTGGCTGTCTTCAGGGT
GCCCGCCTGGGCCTGTCTCCTCTGCTTCACAACCTACTCTGAGCGCCTCCGCATCTGCCAGAT
GTTTGTTGGGATGCGGAGCCCCAAGCTTGAAGAGTGTGAGGAGGCCTTCACGGCCGCCTTCCA
GGGCCTCTCTGACACCGAAATCAGTGAGGAGACCATCCACACTTCATCAGTGTCCTGGGGAAG
GTGCAGAGGGAGGGCAGGAGAGGCCCAGAGGGTCAGGCTGAGGGACAGACAGAGAGAAACAGT
CAGAGGAGAAAGGCTCAAAGACCATGAGAACAACAGAGACTTAGGGACAGAGAGACACAGACA
GGGGAAGACAGCAGGGCAAAGACTCAGAGAGGGGAGGATGGAGAGTCAGAGAGGGGAAGATGG
AGACTCAGAGAGAGGGGAGGATGGAGACTCAGAGAGAGAGGAAGATGGAGACTCAGAGGGAAA
GATGGAGACTCAGGAGTATGGAGAGTCAGAGAGGGGAGGATGGACACTCAGGGGAGGATGGAG
AGTCAGGAGGATGGAGACTCATAGAAAGGGGAGGATGGAGAGTCAGGAGAGGTTGGAGACTGG
AGAGGGAATAGAGACCCAGAAAGGGGAGGATGGAGACTCAGAGGGTGGAAGATGGAGACTCAA
AGAGGATGGAAACCCAGAGAGAGGAGGACAGAGATGAGGCAGAGACTAGGGGAAGCAGGATAG
CGACTGGTCGGGGCAGAGACTCAGGGAGGATAGAGACTCACAGAGAGGTGAGGATAGAGACT
TGGGAGGGACTCAGGAAGCATAGCGACTGTGGGCAAAGAGTCAGAGAGGGGAGGATACAGAC
TTGGGAGGGCAGAGACTCAGAAACAGAATGTTCGCATTAGGGACATGGTGTTGCGGGAGCTG
CCTCCCCCAGCCCCTGCTCCCTCCCTCACCGCCAGACTATGATGAGAGAAGCCACCTGCATGA
CACCTTCACCCAGATGACCCATGCCCTGCAGGAGCTGGCTGCTGCCCAGGGATCCTTTGAGGT
TGCCTTCCCTGATGCTGCAGAGAAAATGAAGAAGGTCATTACACAGCTTAAAGAAGCCCAGGC
TTGCATCCCTCCCTGCGGTCTCCAGGAGTTCGCCCGGCGTTTCCTCTGCAGCGGGTGCTACTC
TAGGGTCTGCGACCTCCCGCTGGACTGCCCAGTTCAGGATGTGACAGTGACTCGGGGCGACCA
GGCTATGTTTTCTTGCATCGTAAACTTCCAGCTGCCAAAGGAGGAGATCACCTATTCCTGGAA
GTTCGCAGGAGGAGGTCTCCGGACTCAGGACTTGTCCTATTTCCGAGATATGCCGCGGGCCGA
AGGATACCTGGCGCGGATCCGGCCGGCTCAGCTCACGCACCGCGGGACGTTCTCCTGCGTGAT
CAAGCAAGACCAGCGCCCCCTGGCCCGGCTCTACTTCTTTCTTAACGTCCTCGGGGCCCTCGC
ATCAGCGAGTGCGACAGTGTTGGCGTGGTGAGTTCTGGGGACTCCGGAGCCCCAGCATCTAGC
TCCCCGCTGTCTCAGATCCCACCGAGAAGTCTGGGTTCCCAGCAACCTCCAACCCAGGAGGAT
GTTCTTTCGATGGTACTGCAGTGGCAACTAACAAAGGTATCTTTCCTCCTTCCCTATCCTATT
TCCATCCTGAAAATAAAGAATATATTTCAACTCTAAAAAAAAAAAAAAAAAAAAAAAAAAAAA
AAAAAAAAAAAAAA
```

FIGURE 164

MALLALASAVPSALLALAVFRVPAWACLLCFTTYSERLRICQMFVGMRSPKLEECEEAFTAAF
QGLSDTEISEETIHTSSVSWGRCRGRAGEAQRVRLRDRQRETVRGERLKDHENNRDLGTERHR
QGKTAGQRLREGRMESQRGEDGDSERGEDGDSEREEDGDSEGKMETQEYGESERGGWTLRGGW
RVRRMETHRKGRMESQERLETGEGIETQKGEDGDSEGGRWRLKEDGNPERGGQR

Signal peptide:
amino acids 1-26

N-myristoylation site.
amino acids 65-71

FIGURE 165

CAGAATCGCAGATTGCCAGCCCTTTTCCCGACCCCTACGGAAGACGAGTCCAGGGGCCGTCC
TGGCGAGGTCAAAACATTTAGTCTGGTCTTTTCAGCGTGGACCCTGCCAGCAGCCAGGCATG
GAGCTCTCTGATGTCACCCTCATTGAGGGTGTGGGTAATGAGGTGATGGTGGTGGCAGGTGT
GTGGTGCTGATTCTAGCCTTGGTCCTAGCTTGGCTCTCTACCTACGTAGCAGACAGCGGTAGC
AACCAGCTCCTGGGCGCTATTGTGTCAGCAGGCGACACATCCGTCCTCCACCTGGGGCATGTG
GACCACCTGGTGGCAGGCCAAGGCAACCCCGAGCCAACTGAACTCCCCCATCCATCAGAGGGT
AATGATGAGAAGGCTGAAGAGGCGGGTGAAGGTCGGGGAGACTCCACTGGGGAGGCTGGAGCT
GGGGGTGGTGTTGAGCCCAGCCTTGAGCATCTCCTTGACATCCAAGGCCTGCCCAAAAGACAA
GCAGGTGCAGGCAGCAGCAGTCCAGAGGCCCCCCTGAGATCTGAGGATAGCACCTGCCTCCCT
CCCAGCCCTGGCCTCATCACTGTGCGGCTCAAATTCCTCAATGATACCGAGGAGCTGGCTGTG
GCTAGGCCAGAGGATACCGTGGGTGCCCTGAAGAGCAAATACTTCCCTGGACAAGAAAGCCAG
ATGAAACTGATCTACCAGGGCCGCCTGCTACAAGACCCAGCCCGCACACTGCGTTCTCTGAAC
ATTACCGACAACTGTGTGATTCACTGCCACCGCTCACCCCAGGGTCAGCTGTTCCAGGCCCC
TCAGCCTCCTTGGCCCCCTCGGCCACTGAGCCACCCAGCCTTGGTGTCAATGTGGGCAGCCTC
ATGGTGCCTGTCTTTGTGGTGCTGTTGGGTGTGGTCTGGTACTTCCGAATCAATTACCGCCAA
TTCTTCACAGCACCTGCCACTGTCTCCCTGGTGGGAGTCACCGTCTTCTTCAGCTTCCTAGTA
TTTGGGATGTATGGACGATAAGGACATAGGAAGAAAATGAAAGGCATGGTCTTTCTCCTTTAT
GGCCTCCCCACTTTTCCTGGCCAGAGCTGGGCCCAAGGGCCGGGGAGGGAGGGTGGAAAGGA
TGTGATGGAAATCTCCTCCATAGGACACAGGAGGCAAGTATGCGGCCTCCCCTTCTCATCCAC
AGGAGTACAGATGTCCCTCCCGTGCGAGCACAACTCAGGTAGAAATGAGGATGTCATCTTCCT
TCACTTTTAGGGTCCTCTGAAGGAGTTCAAAGCTGCTGGCCAAGCTCAGTGGGGAGCCTGGGC
TCTGAGATTCCCTCCCACCTGTGGTTCTGACTCTTCCCAGTGTCCTGCATGTCTGCCCCAGC
ACCCAGGGCTGCCTGCAAGGGCAGCTCAGCATGGCCCCAGCACAACTCCGTAGGGAGCCTGGA
GTATCCTTCCATTTCTCAGCCAAATACTCATCTTTTGAGACTGAAATCACACTGGCGGGAATG
AAGATTGTGCCAGCCTTCTCTTATGGGCACCTAGCCGCCTTCACCTTCTTCCTCTACCCCTTA
GCAGGAATAGGGTGTCCTCCCTTCTTTCAAAGCACTTTGCTTGCATTTTATTTTATTTTTTA
AGAGTCCTTCATAGAGCTCAGTCAGGAAGGGGATGGGGCACCAAGCCAAGCCCCCAGCATTGG
GAGCGGCCAGGCCACAGCTGCTGCTCCCGTAGTCCTCAGGCTGTAAGCAAGAGACAGCACTGG
CCCTTGGCCAGCGTCCTACCCTGCCCAACTCCAAGGACTGGGTATGGATCGCTGGGCCCTAGG
CTCTTGCTTCTGGGGCTATTGGAGGGTCAGTGTCTGTGACTGAATAAAGTTCCATTTTGTGGA
AAAAAAAAAAAAAAAAAAAAAAAAAAAAAAAAAAAAAAAAAAAAAAA

FIGURE 166

MELSDVTLIEGVGNEVMVVAGVVVLILALVLAWLSTYVADSGSNQLLGAIVSAGDTSVLHLGH
VDHLVAGQGNPEPTELPHPSEGNDEKAEEAGEGRGDSTGEAGAGGGVEPSLEHLLDIQGLPKR
QAGAGSSSPEAPLRSEDSTCLPPSPGLITVRLKFLNDTEELAVARPEDTVGALKSKYFPGQES
QMKLIYQGRLLQDPARTLRSLNITDNCVIHCHRSPPGSAVPGPSASLAPSATEPPSLGVNVGS
LMVPVFVVLLGVVWYFRINYRQFFTAPATVSLVGVTVFFSFLVFGMYGR

Signal peptide:

amino acids 1-36

Transmembrane domains:

amino acids 246-267, 275-301

N-glycosylation sites.

amino acids 162-166, 211-215

N-myristoylation sites.

amino acids 48-54, 105-111, 109-115, 129-135, 177-183, 247-253

Cell attachment sequence.

amino acids 97-100

FIGURE 167

```
GGCGGCTGTGTGTCGCCGGAGCCGAAGCGCGCAGGCCCGTCCCGGTGGCCGGGGAGCGGGCGGGTGGGGGCGCCA
TGTGGTTCATGTACCTGCTGAGCTGGCTGTCGCTCTTCATCCAGGTGGCCTTCATCACGCTGGCTGTCGCGGCTG
GACTCTATTACCTGGCAGAACTGATAGAAGAATACACAGTGGCCACCAGCAGGATCATAAAATACATGATCTGGT
TCTCCACCGCTGTACTGATTGGCCTCTACGTCTTTGAGCGCTTCCCCACCAGCATGATTGGAGTGGGCCTATTCA
CCAACCTCGTCTACTTTGGCCTCCTCCAGACCTTCCCCTTCATCATGCTGACCTCGCCTAACTTCATCCTGTCGT
GTGGACTAGTGGTGGTGAATCATTACCTAGCATTTCAGTTTTTTGCAGAAGAATATTATCCCTTCTCAGAGGTCC
TGGCCTATTTCACTTTCTGCCTGTGGATAATTCCGTTTGCGTTTTTTGTGTCACTTTCGGCCGGGGAGAACGTCC
TGCCCTCTACCATGCAGCCAGGAGATGATGTCGTCTCCAATTATTTCACCAAAGGCAAGCGGGCAAACGCTTAG
GGATCCTGGTTGTCTTCTCCTTCATCAAAGAGGCCATTCTACCCAGTCGTCAGAAGATATACTGACCCCCATGCA
GGCAGGATGTGGGGGGCAAGATCAGGAGAGTCAGGCCCCTGGGCCTCTATGCCAGGTGGGGACCAGAAGTCGGGA
AGGCACCTACCACCTGCCCTGGCTTTCTTCCCCTCAACTCTGGAGCCCCATCCCCACCCTCCTGGGGGCTCAG
CTTGGCTCAGATCTGATGCTTCAAGAGGCTGTAACCTCAGAGGGCACCAAGGAGGGTGGCAGAGCCTGCTTAGCC
AGGAGGCCGAGGTCCCTCAGTCCTCCCCTGTCCCTTCCAAGGTGGGTCAGGAGGTTCTGGCCCCGCTGGGGCAGG
CAGGGCAGGGTCTGTGAAGCTTAAGAGCAGATGGTGACAAGTTCTCTGGGCAGGTGGCCATGGGGAGGGGCCATG
GCTTGGCATGTCCAACAGAAATAGTTTTTGCTGTTGAACGGTGATTTCTGTCCAAGTGCAGATTTCCGTTTGAAT
AAAGCTTCGCTTCTAGGTGGCACTGTTTGCCTTAATACCCTGACAGTTCATCTTCCTTTCTTCCTGCTAACCTTC
TGCTCTGGACTGGACTCACTTTTCTGCTCCAGGGACTCCTTTTCTGGGTTTGGGTCTTGCCCTTCCCAAGGGACT
GTTCTTGTGGCCCTTAATGGGAAGGGGCAGGGGTGAGGAGCTGAGCCTGCTCAAGGAGTGGGAAGTGGGGCTAT
AGGCAGCCTCTCTGATGCACTCTCTTCCATCTCTTTCCCCAAGGCTCCGTGACTGTCAAACTGGGAGTAGGAGAG
GGGACAATTTAGGACTGGGCTAGATTTTCAGAAGAACATCTACAATATCCTATTTATAAATCTTCCTCTGGGAAA
AGGAGTGGTTTCTGGCTGAATACTATCTTAGGCTCAAGGAGAAACAAAATAAAAATTAGCTTCCAGGCAGCCTGT
TTTTAAAGAAATGGGACTAATGGGAGAAGCTGTTTGTCACTCTAAGAGCATCCAAGCCCTGGCCCGTCTGTGCAC
TCTTGGCTCCTGGGGAGATATATCTGCCTTCTAAGAAGGCAGGCCAGGTCTTGGGCACAGACCTGCATTTGTTGA
CCTTGCACTCCAACTATAGTGCCTTGCAAGTGCTCAACAGTACATATTGGAATGAAGTCCCTATGAGAGCCATTT
CTGGCCATGTTCTATACCTCAAAGTGAGGCTGGCAGGTACAGAGATGAACTGTACACATGTGATACATTTAAGCC
ACTGGAAAAACCCCTGTGCTTGAAAATATTTCCTCTATATCATGCCTGGAGTTCCATCATAGCCCTTCATTTCCT
TGGCTTTAGCATTTACCTTCTCTTAAGAATACCAGCTTTCCCCTTTCCCTGAGAGGAAGAGCACATGTTGGTCTC
CTCTTAGTGTGAACGAGATTGCCAGGCCCTTTTCTCCTATGCACACCAGGATAGACAAGGCAGGGGATACTGGCA
GCCTGCATCATCCTCCCATTGGGCTGACAGCTGGCCCTACTTTCCTCCCTCTGCTGCTTGGTCCCTCACCTTGAT
GATGTGGCTTCGCCCCCTCCACTCTACTGCCAGTGTTCTCCCAGGGGTTGCTAAATCCAGCAGACCCCTTTCCTG
TCTTACTAGATCTGGGCAGCATTTGACATGGCTGATCACCCCTTGCTTCTTGGATGGCACTTCCCTGGCACCTCT
GTGGCTAGTTGTCCTACCTCCCTGGCTGTTCCTTTCAGGCTTCCGTGCAGGCTTCTCCACTTGCCCATGCACAGT
AGGGTCTTTCAGGGTTCTGCTGTGGGCTCCCTAGGGAAGCCCATCCATCTGGATGGTTTCAAGGATGGTGAGGAA
TTTAGAGTTGACCTCCAGCCCCAACATCCTTCCTGATCACCTGAACCACAGTTTTGCTGCCCTCTAGGTGCACAG
ACAATTCAGGTCCATGGCCCAGATGGTACTTGCTGTCTTCTGCAAACCTGCCCCTTCTGGGTACTTCCCTTGACC
CCGAGATCACTCAGGAGCCAGACAGGAAACTTATTCTATTCCTGTTTTCTCTTTCTGCCCACCACATCCAATCTC
TCAAAACGGTCAGGTCTACCTTAACATCTCTTGATTTGAGCCACTCCCACTGTCATCAGCTTTCACCTGGATTAT
CGTGACAGCCTCCTACTGCTTCTCTATCATGTGGCCAGAGCTATCTTCCTAAAATGCATTGCATAGTTGATCAAG
TCACTCTCTGGCCTAAAACCTTCCTTGGCTCCCTGCTGCCCTCAGGATAAAGTCTGGACCCCTCAGCATGGCTTG
TGAGACTCATGGTGTCCTTGTCCCTGCTCACCTCTGTGGTCTCATCACTTGCCTTCTTGCATTCTGGGTCCCAGC
CTCCTGTATCCAGAGATGCAGTGGCTCTCCATTGCCACTCTGATTCCTCCTTTCTTTTGGTCACAGAGAAAGGGT
ACTTTCTCTGTCAAATCTCAACTTAGACTTGACTTCCTCCAAGGAGCTTTGGCTATACTCTCTCCTCCCGACCCC
CACCCTGGCATACTACACAGATCACTCTGGGCTCACTTGCCTGCCTAATGGTCATCTCCCAGTAGACTGTAAGC
TCCTTGAGGGCAAGGATTGTGTTGGAATTTTTGTATTAACAGTGCCTGGCTTGGTGCCTGGCACCTAGAAAGCAC
TCAATAAATGTTTGTTTAATGAA
```

FIGURE 168

MWFMYLLSWLSLFIQVAFITLAVAAGLYYLAELIEEYTVATSRIIKYMIWFSTAVLIGLYVFE
RFPTSMIGVGLFTNLVYFGLLQTFPFIMLTSPNFILSCGLVVVNHYLAFQFFAEEYYPFSEVL
AYFTFCLWIIPFAFFVSLSAGENVLPSTMQPGDDVVSNYFTKGKRGKRLGILVVFSFIKEAIL
PSRQKIY

Signal peptide:

amino acids 1-25

Transmembrane domain:

amino acids 126-146

Casein kinase II phosphorylation site.

amino acids 145-148

N-myristoylation sites.

amino acids 73-78, 82-87

Amidation sites.

amino acids 168-171, 171-174

Prokaryotic membrane lipoprotein lipid attachment site.

amino acids 91-101

FIGURE 169

CAAAGCCCTACCCTCACCATTCACCAGGTCCTGTGGGAAGAGCAGCGTGGAGGTGGGCTGAGG
TTAGAAGGTGCAGAGCGTGGAAGAAGATTGTGAGCTGAGTATTGGACATCTGTTCTTGAATAG
TCCCTGGGCCTGCCATAGGAAAGGAAGTTCTCCAGGGTTACAGTTCTTATCCGCGTGAATACA
CATGGCTCTGTTACGAAAAATTAATCAGGTGCTGCTGTTCCTTCTGATCGTGACCCTCTGTGT
GATTCTGTATAAGAAAGTTCATAAGGGGACTGTGCCCAAGAATGACGCAGATGATGAATCCGA
GACTCCTGAAGAACTGGAAGAAGAGATTCCTGTGGTGATTTGTGCTGCAGCAGGGAGGATGGG
TGCCACTATGGCTGCCATCAATAGCATCTACAGCAACACTGACGCCAACATCTTGTTCTATGT
AGTGGGACTCCGGAATACTCTGACTCGAATACGAAAATGGATTGAACATTCCAAACTGAGAGA
AATAAACTTTAAAATCGTGGAATTCAACCCGATGGTCCTCAAAGGGAAGATCAGACCAGACTC
ATCGAGGCCTGAATTGCTCCAGCCTCTGAACTTTGTTCGATTTTATCTCCCTCTACTTATCCA
CCAACACGAGAAAGTCATCTATTTGGACGATGATGTAATTGTACAAGGTGATATCCAAGAACT
GTATGACACCACCTTGGCCCTGGGCCACGCGGCGGCTTTCTCAGATGACTGCGATTTGCCCTC
TGCTCAGGACATAAACAGACTCGTGGGACTTCAGAACACATATATGGGCTATCTGGACTACCG
GAAGAAGGCCATCAAGGACCTTGGCATCAGCCCCAGCACCTGCTCTTTCAATCCTGGTGTGAT
TGTTGCCAACATGACAGAATGGAAGCACCAGCGCATCACCAAGCAATTGGAGAAATGGATGCA
AAAGAATGTGGAGGAAAACCTCTATAGCAGCTCCCTGGGAGGAGGGTGGCCACCTCCCCAAT
GCTGATTGTGTTTCATGGGAAATATTCCACAATTAACCCCCTGTGGCACATAAGGCACCTGGG
CTGGAATCCAGATGCCAGATATTCGGAGCATTTTCTGCAGGAAGCTAAATTACTCCACTGGAA
TGGAAGACATAAACCTTGGGACTTCCCTAGTGTTCACAACGACTTATGGGAAAGCTGGTTTGT
TCCTGACCCTGCAGGGATATTTAAACTCAATCACCATAGCTGATATAACTCTACCCTTAAAAT
ATTCCCTGTATAGAAATGTGGAATTGTCCCTTTGTAGCCAACTATAACATTGTTCTTTATGAA
TATTACCTTTGATACATATGATCCACAATATAAAAACCAAAAACTACTGTGTGCAAATTATAC
CTTGGACCATATAGGCATTGATTAACTTCTTTAAGTACATGTGATAACTATGGAAATCAAGAT
TATGTGACTGAAAAACATAAAGGAAGAGACCCATCTAGATAACAGCAATCAACCTGCTTAATT
CTGAATGACAATTATATCCACAAATTTTTAAAACTTCTACATGTATTTTTCACATGAAGATCT
CCTTAACAGGTTGCCAACCTTTTCTTTTATAAAACTATTACATTTAAAATATGGACGTCTGAA
AAATAAAATATTCATCATTTTTAAAA

FIGURE 170

MALLRKINQVLLFLLIVTLCVILYKKVHKGTVPKNDADDESETPEELEEEIPVVICAAAGRMG
ATMAAINSIYSNTDANILFYVVGLRNTLTRIRKWIEHSKLREINFKIVEFNPMVLKGKIRPDS
SRPELLQPLNFVRFYLPLLIHQHEKVIYLDDDVIVQGDIQELYDTTLALGHAAAFSDDCDLPS
AQDINRLVGLQNTYMGYLDYRKKAIKDLGISPSTCSFNPGVIVANMTEWKHQRITKQLEKWMQ
KNVEENLYSSSLGGGVATSPMLIVFHGKYSTINPLWHIRHLGWNPDARYSEHFLQEAKLLHWN
GRHKPWDFPSVHNDLWESWFVPDPAGIFKLNHHS

Signal peptide:

amino acids 1-20

N-glycosylation site.

amino acids 234-238

Tyrosine kinase phosphorylation site.

amino acids 253-261

N-myristoylation sites.

amino acids 63-69, 86-92, 198-204, 218-224, 229-235, 265-271, 266-272

FIGURE 171

GCCAGAGGCTGCAGCTGGAGCCCAGAGCCCAAG<u>ATG</u>GAGCCCCAGCTGGGGCCTGAGGCTGCC
GCCCTCCGCCCTGGCTGGCTGGCCCTGCTGCTGTGGGTCTCAGCCCTGAGCTGTTCTTTCTCC
TTGCCAGCTTCTTCCCTTTCTTCTCTGGTGCCCCAAGTCAGAACCAGCTACAATTTTGGAAGG
ACTTTCCTCGGTCTTGATAAATGCAATGCCTGCATCGGGACATCTATTTGCAAGAAGTTCTTT
AAAGAAGAAATAAGATCTGACAACTGGCTGGCTTCCCACCTTGGACTGCCTCCCGATTCCTTG
CTTTCTTATCCTGCAAATTACTCAGATGATTCCAAAATCTGGCGCCCTGTGGAGATCTTTAGA
CTGGTCAGCAAATATCAAAACGAGATCTCAGACAGGAGAATCTGTGCCTCTGCATCAGCCCCA
AAGACCTGCAGCATTGAGCGTGTCCTGCGGAAAACAGAGAGGTTCCAGAAATGGCTGCAGGCC
AAGCGCCTCACGCCGGACCTGGTGCAGGACTGTCACCAGGGCCAGAGAGAACTAAAGTTCCTG
TGTATGCTGAGA<u>TAA</u>CACCAGTGAAAAAGCCTGGCATGGAGCCCAGCACTGAGAACTTCCAGA
AAGTGTTAGCCTTCTCCCAACTGTGTTATACCAACCACATTTTCAAATAGTAATCATTAAAGA
GGCTTCTGCATCAAAAAAAAAAAAAAAAAAAAAAAAAAAAAAAAAAAAAAAAAAAAAAAAAAA

FIGURE 172

MEPQLGPEAAALRPGWLALLLWVSALSCSFSLPASSLSSLVPQVRTSYNFGRTFLGLDKCNAC
IGTSICKKFFKEEIRSDNWLASHLGLPPDSLLSYPANYSDDSKIWRPVEIFRLVSKYQNEISD
RRICASASAPKTCSIERVLRKTERFQKWLQAKRLTPDLVQDCHQGQRELKFLCMLR

Signal peptide:

amino acids 1-28

N-glycosylation site.

amino acids 100-103 cAMP- and cGMP-dependent protein kinase phosphorylation site.

amino acids 158-161

N-myristoylation sites.

amino acids 56-61, 65-70

Prokaryotic membrane lipoprotein lipid attachment site.

amino acids 18-28

Prenyl group binding site (CAAX box).

amino acids 179-182

Leucine zipper pattern.

amino acids 5-26

FIGURE 173

GCTGGACTGCTCGCTGGCCGGCAGCGCACCGTTTTGAAGGTCCTAGCCCACCTGGGCTGGCTC
ACGCGCACGACTAGCCGCTCCCATACAGCACGCCCGGACTCTGTCGTCGCTTAAGGCCACTCC
TATTCTACGGCTGACCCCTGGTGGTCACGTGGATCTGTTCGCCACGCAAGTCTGGGTCCTTCG
GCGATTGACCGGGGTCCTTGCTGTTCGGGAGCCTCTCCTAAGCTGCCTGTTCGCGCGAGAGTT
TGGAGGGGCGGGTTTGGGGTCGGTGTCTGATTGGGGCTCGCACCGCAGCACGCTGGAGTCCCG
CTTAGGTACCAGTTAGCGTCAGGGGAGCTGGGTCAGGCGGTCGCCGGGACACCCGTGTGTGG
CAGGCGGCGAAGCGCTCTGGAGAATCCCGGACAGCCCTGCTCCCTGCAGCCAGGTGTAGTTTC
GGGAGCCACTGGGGCCAAAGTGAGAGTCCAGCGGTCTTCCAGCGCTTGGGCCACGGCGGCGGC
CCTGGGAGCAGAGGTGGAGCGACCCCATTACGCTAAAG<u>ATG</u>AAAGGCTGGGGTTGGCTGGCCC
TGCTTCTGGGGGCCCTGCTGGGAACCGCCTGGGCTCGGAGGAGCCAGGATCTCCACTGTGGAG
CATGCAGGGCTCTGGTGGATGAACTAGAATGGGAAATTGCCCAGGTGGACCCCAAGAAGACCA
TTCAGATGGGATCTTTCCGGATCAATCCAGATGGCAGCCAGTCAGTGGTGGAGGTGCCTTATG
CCCGCTCAGAGGCCCACCTCACAGAGCTGCTGGAGGAGATATGTGACCGGATGAAGGAGTATG
GGGAACAGATTGATCCTTCCACCCATCGCAAGAACTACGTACGTGTAGTGGGCCGGAATGGAG
AATCCAGTGAACTGGACCTACAAGGCATCCGAATCGACTCAGATATTAGCGGCACCCTCAAGT
TTGCGTGTGAGAGCATTGTGGAGGAATACGAGGATGAACTCATTGAATTCTTTTCCCGAGAGG
CTGACAATGTTAAAGACAAACTTTGCAGTAAGCGAACAGATCTTTGTGACCATGCCCTGCACA
TATCGCATGATGAGCTA<u>TGA</u>ACCACTGGAGCAGCCCACACTGGCTTGATGGATCACCCCAGG
AGGGGAAAATGGTGGCAATGCCTTTTATATATTATGTTTTTACTGAAATTAACTGAAAAAATA
TGAAACCAAAAGT

FIGURE 174

MKGWGWLALLLGALLGTAWARRSQDLHCGACRALVDELEWEIAQVDPKKTIQMGSFRINPDGS
QSVVEVPYARSEAHLTELLEEICDRMKEYGEQIDPSTHRKNYVRVVGRNGESSELDLQGIRID
SDISGTLKFACESIVEEYEDELIEFFSREADNVKDKLCSKRTDLCDHALHISHDEL

Signal peptide:

amino acids 1-20

N-myristoylation sites.

amino acids 12-18, 16-22, 29-35

Endoplasmic reticulum targeting sequence.

amino acids 179-184

FIGURE 175

```
CGCAGCGCGGCAGTCCTGATGGCCCGGCATGGGTTACCGCTGCTGCCCCTGCTGTCGCTCCTG
GTCGGCGCGTGGCTCAAGCTAGGAAATGGACAGGCTACTAGCATGGTCCAACTGCAGGGTGGG
AGATTCCTGATGGGAACAAATTCTCCAGACAGCAGAGATGGTGAAGGGCCTGTGCGGGAGGCG
ACAGTGAAACCCTTTGCCATCGACATATTTCCTGTCACCAACAAAGATTTCAGGGATTTTGTC
AGGGAGAAAAAGTATCGGACAGAAGCTGAGATGTTTGGATGGAGCTTTGTCTTTGAGGACTTT
GTCTCTGATGAGCTGAGAAACAAAGCCACCCAGCCAATGAAGTCTGTACTCTGGTGGCTTCCA
GTGGAAAAGGCATTTTGGAGGCAGCCTGCAGGTCCTGGCTCTGGCATCCGAGAGAGACTGGAG
CACCCAGTGTTACACGTGAGCTGGAATGACGCCCGTGCCTACTGTGCTTGGCGGGGAAAACGA
CTGCCCACGGAGGAAGAGTGGGAGTTTGCCGCCCGAGGGGGCTTGAAGGGTCAAGTTTACCCA
TGGGGGAACTGGTTCCAGCCAAACCGCACCAACCTGTGGCAGGGAAAGTTCCCCAAGGGAGAC
AAAGCTGAGGATGGCTTCCATGGAGTCTCCCCAGTGAATGCTTTCCCCGCCCAGAACAACTAC
GGGCTCTATGACCTCCTGGGGAACGTGTGGGAGTGGACAGCATCACCGTACCAGGCTGCTGAG
CAGGACATGCGCGTCCTCCGGGGGGCATCCTGGATCGACACAGCTGATGGCTCTGCCAATCAC
CGGGCCCGGGTCACCACCAGGATGGGCAACACTCCAGATTCAGCCTCAGACAACCTCGGTTTC
CGCTGTGCTGCAGACGCAGGCCGGCCGCCAGGGGAGCTGTAAGCAGCCGGGTGGTGACAAGGA
GAAAAGCCTTCTAGGGTCACTGTCATTCCCTGGCCATGTTGCAAACAGCGCAATTCCAAGCTC
GAGAGCTTCAGCCTCAGGAAAGAACTTCCCCTTCCCTGTCTCCATCCCTCTGTGGCAGGCGC
CTCTCACCAGGGCAGGAGAGGACTCAGCCTCCTGTGTTTTGGAGAAGGGGCCCAATGTGTGTT
GACGATGGCTGGGGGCCAGGTGTTTCTGTTAGAGGCCAAGTATTATTGACACAGGATTGCAAA
CACACAAACAGTTGGAACAGAGCACTCTGAAAGGCCATTTTTTAAGCATTTTAAAATCTATTC
TCTCCCCCTTTCTCCCTGGATGATTCAGGAAGCTGACATTGTTTCCTCAAGGCAGAATTTTCC
TGGTTCTGTTTTCTCAGCCAGTTGCTGTGGAAGGAGAATGCTTTCTTTGTGGCCTCATCTGTG
GTTTCGTGTCCCTCTGAAGGAAACTAGTTTCCACTGTGTAACAGGCAGACATGTAACTATTTA
AAGCACAGTTCAGTCCTAAAAGGGTCTGGGAGAACCAGATGATGTACTAGGTGAAGCATTGCA
TTGTGGGAATCACAAAGCAAATAGTACTCCAGAAAGACAAATATCAGAAGCTTCCTATTCTTT
TTTTTTTTTTTTTTTTTTTTGAGACAGGGTCTTTCTCTGTTGCCCAGGCTAGAGTGCACTG
GTGATCACGGCTCACTCTAGCCTTGAATTCCTGGGCCCAAGCAATTCTCCCACCTCAGCCTCC
TGAGTAGCTGGGACTACAAGTGTGCACCACCATGCCTGGCTAATTTTTTGAATTTTTGTAGTG
ATGGGATCTCGCTCTGTTGCCCAGGGTGGTCTCGAACTCCTGGCCTCAAGCGATCCTCCCACC
TCGACCTCCCAAAGTGCTGGGATTACAGGTGTGAGCCACCTCGCCTGGGCCCCTTCTCCATA
TGCCTCCAAAAACATGTCCCTGGAGAGTAGCCTGCTCCCACACTGTCACTGGATGTCATGGGG
CCAATAAAATCTCCTGCAATTGTGTATCTCAAAAAAAAAAAAAAAAAAAAAAAAAAAAAAAAAA
AAAAAAAAAA
```

FIGURE 176

MARHGLPLLPLLSLLVGAWLKLGNGQATSMVQLQGGRFLMGTNSPDSRDGEGPVREATVKPFA
IDIFPVTNKDFRDFVREKKYRTEAEMFGWSFVFEDFVSDELRNKATQPMKSVLWWLPVEKAFW
RQPAGPGSGIRERLEHPVLHVSWNDARAYCAWRGKRLPTEEEWEFAARGGLKGQVYPWGNWFQ
PNRTNLWQGKFPKGDKAEDGFHGVSPVNAFPAQNNYGLYDLLGNVWEWTASPYQAAEQDMRVL
RGASWIDTADGSANHRARVTTRMGNTPDSASDNLGFRCAADAGRPPGEL

Signal peptide:

amino acids 1-20

N-glycosylation site.

amino acids 191-195

N-myristoylation sites.

amino acids 23-29, 25-31, 175-181

Amidation site.

amino acids 159-163

FIGURE 177

GCCTTCTCGCGCCTGACCATGCACCCTGCATCTTCCTGCTGGGCCACAGGCGAGCGCTTTAT
TTCTGGAGCTGAGGGCTAAAACTTTTTTGACTTTTCTTCTCCTCAACATCTGAATCATGCCAT
GTGCCCAGAGGAGCTGGCTTGCAAACCTTTCCGTGGTGGCTCAGCTCCTTAACTTTGGGGCGC
TTTGCTATGGGAGACAGCCTCAGCCAGGCCCGGTTCGCTTCCCGGACAGGAGGCAAGAGCATT
TTATCAAGGGCCTGCCAGAATACCACGTGGTGGGTCCAGTCCGAGTAGATGCCAGTGGCATT
TTTTGTCATATGGCTTGCACTATCCATCACGAGCAGCAGGAGGAAGAGAGATTTGGATGGCT
CAGAGGACTGGGTGTACTACAGAATTTCTCACGAGGAGAAGGACCTGTTTTTTAACTTGACGG
TCAATCAAGGATTTCTTTCCAATAGCTACATCATGGAGAAGAGATATGGGAACCTCTCCCATG
TTAAGATGATGGCTTCCTCTGCCCCCCTCTGCCATCTCAGTGGCACGGTTCTACAGCAGGGCA
CCAGAGTTGGGACGGCAGCCCTCAGTGCCTGCCATGGACTGACTGGATTTTCCAACTACCAC
ATGGAGACTTTTTCATTGAACCCGTGAAGAAGCATCCACTGGTTGAGGGAGGGTACCACCCGC
ACATCGTTTACAGGAGGCAGAAAGTTCCAGAAACCAAGGAGCCAACCTGTGGATTAAAGGGTA
TTGTGACTCACATGTCCTCCTGGGTTGAAGAATCTGTTTTGTTCTTTTGGTAGTTTTATTAAA
ACATGACCTATTCTTACTCAAGTCTCTTATCTCCTCTGTATTCTTTTTTTTTAATATCTTCA
TGACATTCAAATCTCTTCTGTATTCTCTTGCCAGAAAGTGTACATTCTTTTTGCTTGTATAAA
CCCTTTCACTTGTC

FIGURE 178

MPCAQRSWLANLSVVAQLLNFGALCYGRQPQPGPVRFPDRRQEHFIKGLPEYHVVGPVRVDAS
GHFLSYGLHYPITSSRRKRDLDGSEDWVYYRISHEEKDLFFNLTVNQGFLSNSYIMEKRYGNL
SHVKMMASSAPLCHLSGTVLQQGTRVGTAALSACHGLTGFFQLPHGDFFIEPVKKHPLVEGGY
HPHIVYRRQKVPETKEPTCGLKGIVTHMSSWVEESVLFFW

Signal peptide:

amino acids 1-27

N-glycosylation sites.

amino acids 11-15, 105-109, 125-129

N-myristoylation site.

amino acids 149-155

FIGURE 179

```
CAGATTTAAAAAGAAAACCTTTACTGAATCAGCTGAGTGTTAATAATACGAATTTCCTTTTCT
TGCCAATTCTGATCTGAACAGAAATCCAAGAACAGGGATATGTGTGGATTACAGTTTTCTCT
GCCTTGCCTACGACTGTTTCTGGTTGTTACCTGTTATCTTTTATTATTACTCCACAAAGAAAT
ACTTGGATGTTCGTCTGTTTGTCAGCTCTGCACTGGGAGACAAATTAACTGCCGTAACTTAGG
CCTTTCGAGTATTCCTAAGAATTTTCCTGAAAGTACAGTTTTTCTGTATCTGACTGGGAATAA
TATATCTTATATAAATGAAAGTGAATTAACAGGACTTCATTCTCTTGTAGCATTGTATTTGGA
TAATTCTAACATTCTGTATGTATATCCAAAAGCCTTTGTTCAATTGAGGCATCTATATTTTCT
ATTTCTAAATAATAATTTCATCAAACGCTTAGATCCTGGAATATTTAAGGGACTTTTAAATCT
TCGTAATTTATATTTACAGTATAATCAGGTATCTTTTGTTCCGAGAGGAGTATTTAATGATCT
AGTTTCAGTTCAGTACTTAAATCTACAAAGGAATCGCCTCACTGTCCTTGGGAGTGGTACCTT
TGTTGGTATGGTTGCTCTTCGGATACTTGATTTATCAAACAATAACATTTGAGGATATCAGA
ATCAGGCTTTCAACATCTTGAAAACCTTGCTTGTTTGTATTTAGGAAGTAATAATTTAACAAA
AGTACCATCAAATGCCTTTGAAGTACTTAAAAGTCTTAGAAGACTTTCTTTGTCTCATAATCC
TATTGAAGCAATACAGCCCTTTGCATTTAAAGGACTTGCCAATCTGGAATACCTCCTCCTGAA
AAATTCAAGAATTAGGAATGTTACTAGGGATGGGTTTAGTGGAATTAATAATCTTAAACATTT
GATCTTAAGTCATAATGATTTAGAGAATTTAAATTCTGACACATTCAGTTTGTTAAAGAATTT
AATTTACCTTAAGTTAGATAGAAACAGAATAATTAGCATTGATAATGATACATTTGAAAATAT
GGGAGCATCTTTGAAGATCCTTAATCTGTCATTTAATAATCTTACAGCCTTGCATCCAAGGGT
CCTTAAGCCGTTGTCTTCATTGATTCATCTTCAGGCAAATTCTAATCCTTGGGAATGTAACTG
CAAACTTTTGGGCCTTCGAGACTGGCTAGCATCTTCAGCCATTACTCTAAACATCTATTGTCA
GAATCCCCCATCCATGCGTGGCAGAGCATTACGTTATATTAACATTACAAATTGTGTTACATC
TTCAATAAATGTATCCAGAGCTTGGGCTGTTGTAAAATCTCCTCATATTCATCACAAGACTAC
TGCGCTAATGATGGCCTGGCATAAAGTAACCACAAATGGCAGTCCTCTGGAAAATACTGAGAC
TGAGAACATTACTTTCTGGGAACGAATTCCTACTTCACCTGCTGGTAGATTTTTTCAAGAGAA
TGCCTTTGGTAATCCATTAGAGACTACAGCAGTGTTACCTGTGCAAATACAACTTACTACTTC
TGTTACCTTGAACTTGGAAAAAAACAGTGCTCTACCGAATGATGCTGCTTCAATGTCAGGGAA
AACATCTCTAATTTGTACACAAGAAGTTGAGAAGTTGAATGAGGCTTTTGACATTTTGCTAGC
TTTTTTCATCTTAGCTTGTGTTTTAATCATTTTTTTGATCTACAAAGTTGTTCAGTTTAAACA
AAAACTAAAGGCATCAGAAAACTCAAGGGAAAATAGACTTGAATACTACAGCTTTTATCAGTC
AGCAAGGTATAATGTAACTGCCTCAATTTGTAACACTTCCCCAAATTCTCTAGAAAGTCCTGG
CTTGGAGCAGATTCGACTTCATAAACAATTGTTCCTGAAAATGAGGCACAGGTCATTCTTTT
TGAACATTCTGCTTTATAACTCAACTAAATATTGTCTATAAGAAACTTCAGTGCCATGGACAT
GATTTAAACTGAAACCTCCTTATATAATTATATACTTTAGTTGGAAATATAATGAATTATATG
AGGTTAGCATTATTAAAATATGTTTTTTNTTAAAAAAAAAAAAAAAAAAAAAAAAA
```

FIGURE 180

MCGLQFSLPCLRLFLVVTCYLLLLLHKEILGCSSVCQLCTGRQINCRNLGLSSIPKNFPESTV
FLYLTGNNISYINESELTGLHSLVALYLDNSNILYVYPKAFVQLRHLYFLFLNNNFIKRLDPG
IFKGLLNLRNLYLQYNQVSFVPRGVFNDLVSVQYLNLQRNRLTVLGSGTFVGMVALRILDLSN
NNILRISESGFQHLENLACLYLGSNNLTKVPSNAFEVLKSLRRLSLSHNPIEAIQPFAFKGLA
NLEYLLLKNSRIRNVTRDGFSGINNLKHLILSHNDLENLNSDTFSLLKNLIYLKLDRNRIISI
DNDTFENMGASLKILNLSFNNLTALHPRVLKPLSSLIHLQANSNPWECNCKLLGLRDWLASSA
ITLNIYCQNPPSMRGRALRYINITNCVTSSINVSRAWAVVKSPHIHHKTTALMMAWHKVTTNG
SPLENTETENITFWERIPTSPAGRFFQENAFGNPLETTAVLPVQIQLTTSVTLNLEKNSALPN
DAASMSGKTSLICTQEVEKLNEAFDILLAFFILACVLIIFLIYKVVQFKQKLKASENSRENRL
EYYSFYQSARYNVTASICNTSPNSLESPGLEQIRLHKQIVPENEAQVILFEHSAL

Signal peptide:
amino acids 1-41

Transmembrane domain:
amino acids 530-547

N-glycosylation sites.
amino acids 71-75, 76-80, 215-219, 266-270, 317-321, 331-335, 336-340, 400-404, 410-414, 451-455, 579-583 cAMP- and cGMP-dependent protein kinase phosphorylation site.
amino acids 231-235

N-myristoylation sites.
amino acids 3-9, 69-75, 126-132, 174-180

ATP/GTP-binding site motif A (P-loop).
amino acids 506-514

FIGURE 181

GGCCTGGCGCGGCGCTCCGGTAAGGCGTGTGTGCGGCAGGGCGGGGACAGAACCGTCCTCTCG
GGCTCTGGGCGTGTCCGAGACCGCGCTCCCCGCCGAAATCAAGCTCCGAGTCATCCGTGTGGG
GCATTCGTCCCCCCTGGCACAGTTGGCCTCTTTCCAGAAGCCCGTTTTGTTTGTTTTACGTCT
AAATTCGCGTCGGTTCTTATTTCTCTCCCTGGCAAGGTCTGAAGACGGGTAGGAGAATAACCT
GTGTCAGCGTGTTATGATGCCGTCCCGTACCAACCTGGCTACTGGAATCCCCAGTAGTAAAGT
GAAATATTCAAGGCTCTCCAGCACAGACGATGGCTACATTGACCTTCAGTTTAAGAAAACCCC
TCCTAAGATCCCTTATAAGGCCATCGCACTTGCCACTGTGCTGTTTTGATTGGCGCCTTTCT
CATTATTATAGGCTCCCTCCTGCTGTCAGGCTACATCAGCAAAGGGGGGCAGACCGGGCCGT
TCCAGTGCTGATCATTGGCATTCTGGTGTTCCTACCCGGATTTTACCACCTGCGCATCGCTTA
CTATGCATCCAAAGGCTACCGTGGTTACTCCTATGATGACATTCCAGACTTTGATGACTAGCA
CCCACCCCATAGCTGAGGAGGAGTCACAGTGGAACTGTCCCAGCTTTAAGATATCTAGCAGAA
ACTATAGCTGAGGACTAAGGAATTCTGCAGCTTGCAGATGTTTAAGAAAATAATGGCCAGATT
TTTTGGGTCCTTCCCAAAGATGTTAAGTGAACCTACAGTTAGCTAATTAGGACAAGCTCTATT
TTTCATCCCTGGGCCCTGACAAGTTTTTCCACAGGAATATGTATCATGGAAGAATAGAGGTTA
TTCTGTAATGGAAAAGTGTTGCCTGCCACCACCCTCTGTAGAGCTGAGCATTTCTTTTAAATA
GTCTTCATTGCCAATTTGTTCTTGTAGCAAATGGAACAATGTGGTATGGCTAATTTCTTATTA
TTAAGTAGTTTATTTTAAAAATATCTGAGTATATTATCCTGTACACTTATCCCTACCTTCATG
TTCCAGTGGAAGACCTTAGTAAAATCAAAGATCAGTGAGTTCATCTGTAATATTTTTTTTACT
TGCTTTCTTACTGACAGCAACCAGGAATTTTTTATCCTGCAGAGCAAGTTTTCAAAATGTAA
ATACTTCCTCTGTTTAACAGTCCTTGGACCATTCTGATCCAGTTCACCAGTAGGTTGGACAGC
ATATAATTTGCATCATTTGTCCCTTGTAAATCAAGATGTTCTGCAGATTATTCCTTTAACGG
CCGGACTTTTGGCTGTTTCCTAATGAAACATGTAGTGGTTATTATTTAGAGTTTATAGCCGTA
TTGCTAGCACCTTGTAGTATGTCATCATTCTGCTCATGATTCCAAGGATCAGCCTGGATGCCT
AGAGGACTAGATCACCTTAGTTTGATTCTATTTTTTAGCTTGCAAAAGTGACTTATATTCCA
AAGAAATTAAAATGTTGAAATCCAAATCCTAGAAATAAAATGAGTTTNNTTCCAAAAAAAAAA
AAAAAAAAAAAAAAAAAAAAAAAAAAAAAAAAAAAAAAAAAAAAAAA

FIGURE 182

MMPSRTNLATGIPSSKVKYSRLSSTDDGYIDLQFKKTPPKIPYKAIALATVLFLIGAFLIIG
SLLLSGYISKGGADRAVPVLIIGILVFLPGFYHLRIAYYASKGYRGYSYDDIPDFDD

Transmembrane domains:

amino acids 45-66, 79-95

N-myristoylation sites.

amino acids 11-17, 75-81

FIGURE 183

CTAAAAAATACAAAAATTAGCTGGGCGTGGTGTCATGTACCTGTAATCCCAGCTACTCAAGAGGCTGAGGCAGGA
GAATCGCTTGAACCCAGGAGGCAGAGGTTGCAGTGAGCCAAGATTAAGTCACTGCACTCCAGCCTGGGTGACAGA
GCAAGACTCTGTATCAAAATAAATAAATAAAGTACAACTCTGGATGGGCATGGTGGCTTATGTCTGTAATCCCAG
CACTTTGGGAACTTGAGGCGGGTAGATTGCTTGAGTCCGGGAGTTTGAGACCAGTCTGGGTAATATGGTAACCCT
GTCTACCAAAAATACAGGTATTAGCCAGTCTCATAACTCGGTCTCAAAATAAATAAATACATACATACATAGATG
AAAATTTAAAAAATAAAGTCCAACTCAGCGGTTTTCAGCATATTTACAGAGTTGTACAATCTTCACCACTATCTA
ATTTCAGAACATTTTCATCACCCCCAAAAGAAACCTAACCCATTGACTATCTCTCCATTTCCTCCCTCTCCCTAG
CCTCTGGCAACCACTAATCTCTTTTTTGTCTCTATAGATTTGCCTATTTTGGACAGTTCATATACAAGGAATCAT
ACCACATGTAGCCTTTTGTGTCCGGCTTCTTTGATTAATAGAATGTTTTCAAGGCTCATCTATGCTGTAGCCTGT
ATCAGCACTTCATTCCTTTCTATGGCTGAATAATAGTCCACTGTAGGGATGTGCCATGTTTTTCCACTAGCTGAT
GGACATTTGGGTTGTTTCCACCTTCTGGCTATTATAAATATTGCTGCTATAAATATTCACTTACAAGTTTTTGTG
TGGACATATGTTTTTATTTCTTCTGGTATATCCTTCGGAGTGGAACTGCTGGATCAGGTGGTAACTCTAGGTCTA
ACCTGGCAGTTAAACAGAATCCTATGCATGCTGTAGTCCATGAGTTGAAATAAACACTTGACCCATAGTAAGTGC
CAGATCATCTTCATTTCACAGCAACCAGTAATTTCACAGATGAGGAAATGAAGGCTCCCAGAGGTGAACTGGCTT
TTCCCATTTGAGCAGTTCCAAGTCAGACAGTTAAAAAGTGGCAGGACCTGGAAGAGAAGCTAGTTCTTTCACCCT
GGCATTCAGGGCTGCCTCCTGGGCTACGGGGCTGGCATTTAGAATAGAGCTAAGGTCTGCTGCCAAGGCAGGTGC
CCCAGTCTGCCTCCTCTGTGTCCTTATTCCACTTTCTCTGCAGCCCTCCAGGGGACCCCTCTCTCAGCCACCCTC
TCTCTGGTGATGTCACAGTGCTGCCGGAAGATCAAAGATACGGTGCAGAAACTGGCTTCGGACCATAAGGACATT
CACAGCAGTGTATCCCGAGTGGGCAAAGCCATTGACAGGAACTTCGACTCTGAGATCTGTGGTGTTGTGTCAGAT
GCGGTGTGGGACGCGCGGGAACAGCAGCAGCAGATCCTGCAGATGGCCATCGTGGAACACCTGTATCAGCAGGGC
ATGCTCAGCGTGGCCGAGGAGCTGTGCCAGGAATCAACGCTGAATGTGGACTTGGATTTCAAGCAGCCTTTCCTA
GAGTTGAATCGAATCCTGGAAGCCCTGCACGAACAAGACCTGGGTCCTGCGTTGGAATGGGCCGTCTCCCACAGG
CAGCGCCTGCTGGAACTCAACAGCTCCCTGGAGTTCAAGCTGCACCGACTGCACTTCATCCGCCTCTTGGCAGGA
GGCCCCGCGAAGCAGCTGGAGGCCCTCAGCTATGCTCGGCACTTCCAGCCCTTTGCTCGGCTGCACCAGCGGGAG
ATCCAGGTGATGATGGGCAGCCTGGTGTACCTGCGGCTGGGCTTGGAGAAGTCACCCTACTGCCACCTGCTGGAC
AGCAGCCACTGGGCAGAGATCTGTGAGACCTTTACCCGGGACGCCTGTTCCCTGCTGGGGCTTTCTGTGGAGTCC
CCCCTTAGCGTCAGCTTTGCCTCTGGCTGTGTGGCGCTGCCTGTGTTGATGAACATCAAGGCTGTGATTGAGCAG
CGGCAGTGCACTGGGGTCTGGAATCACAAGGACGAGTTACCGATTGAGATTGAACTAGGCATGAAGTGCTGGTAC
GCTCATCTGTGGCCATGTTATCTCCCGAGATGCACTCAATAAGCTCATTAATGGAGGAAACACTCCGTGTTCGCT
TGCCCCATCCTCCGCCAGCAGACGTCAGATTCCAACCCTCCCATCAAGCTGAAGTGTCCCTACTGTCCCATGGAG
CAGAACCCGGCAGATGGGAAACGCATCATATTCTGATTCCTACCTGGAAGGAATTTTGTTGAAAGGGGTTTTCAC
CTGTGAGCCTTGGTCTGTCTCGGTAGGGTGGTCAACTTCAGTGGACTGTGGTTGGTTTCAGAGCGCCTGGCTGAG
GAGTTCCACTGAGGGGAGCACTGGAGCAGCCCTTTGGCAGAGGCTGAGGAGGGAGATGGACCAGCCCACGCCTGG
CACCTGGCTCCATGGCATAAGGAAAGGGAGATGCTGGCCTCTGTGCTCCTGCTGTCTTTTCCTGTTTCTGTTTGC
GTTTGACTTAGTAGCAACCGACAGAGTGGCAAGGGATTTGGTCTTCAGCAGTAGACATCCTTCCACCCCTGCCCT
CAGCCAAGTCTCTTGCTGCCATGCCAATGCTATGTCCACCCTTGCCCCTCGGCCCAAGAGTGTCCAGCGGTGGCC
CACCTCTTCCTCCCACTACAGCCTCAACAGTATGTACCATCTCCCACTGTAAATAGTCCCAGTTAGAACGGAATG
CCGTTGTTTTATAACTTTGAACAAATGTATTTACTGCCCTTCTCAAAA

FIGURE 184

QCCRKIKDTVQKLASDHKDIHSSVSRVGKAIDRNFDSEICGVVSDAVWDAREQQQQILQMAIV
EHLYQQGMLSVAEELCQESTLNVDLDFKQPFLELNRILEALHEQDLGPALEWAVSHRQRLLEL
NSSLEFKLHRLHFIRLLAGGPAKQLEALSYARHFQPFARLHQREIQVMMGSLVYLRLGLEKSP
YCHLLDSSHWAEICETFTRDACSLLGLSVESPLSVSFASGCVALPVLMNIKAVIEQRQCTGVW
NHKDELPIEIELGMKCWYHSVFACPILRQQTSDSNPPIKLICGHVISRDALNKLINGGKLKCP
YCPMEQNPADGKRIIF

Transmembrane domain:

amino acids 222-241

N-glycosylation site.

amino acids 129-133

Tyrosine kinase phosphorylation site.

amino acids 151-159, 184-193

Amidation site.

amino acids 327-331

Prokaryotic membrane lipoprotein lipid attachment site.

amino acids 222-233

FIGURE 185

GAGCGACGCTGTCTCTAGTCGCTGATCCCAAATGCACCGGCTCATCTTTGTCTACACTCTAAT
CTGCGCAAACTTTTGCAGCTGTCGGGACACTTCTGCAACCCCGCAGAGCGCATCCATCAAAGC
TTTGCGCAACGCCAACCTCAGGCGAGATGACTTGTACCGAAGAGATGAGACCATCCAGGTGAA
AGGAAACGGCTACGTGCAGAGTCCTAGATTCCCGAACAGCTACCCCAGGAACCTGCTCCTGAC
ATGGCGGCTTCACTCTCAGGAGAATACACGGATACAGCTAGTGTTTGACAATCAGTTTGGATT
AGAGGAAGCAGAAAATGATATCTGTAGGTATGATTTTGTGGAAGTTGAAGATATATCCGAAAC
CAGTACCATTATTAGAGGACGATGGTGTGGACACAAGGAAGTTCCTCCAAGGATAAAATCAAG
AACGAACCAAATTAAAATCACATTCAAGTCCGATGACTACTTTGTGGCTAAACCTGGATTCAA
GATTTATTATTCTTTGCTGGAAGATTTCCAACCCGCAGCAGCTTCAGAGACCAACTGGGAATC
TGTCACAAGCTCTATTTCAGGGGTATCCTATAACTCTCCATCAGTAACGGATCCCACTCTGAT
TGCGGATGCTCTGGACAAAAAAATTGCAGAATTTGATACAGTGGAAGATCTGCTCAAGTACTT
CAATCCAGAGTCATGGCAAGAAGATCTTGAGAATATGTATCTGGACACCCCTCGGTATCGAGG
CAGGTCATACCATGACCGGAAGTCAAAAGTTGACCTGGATAGGCTCAATGATGATGCCAAGCG
TTACAGTTGCACTCCCAGGAATTACTCGGTCAATATAAGAGAAGAGCTGAAGTTGGCCAATGT
GGTCTTCTTTCCACGTTGCCTCCTCGTGCAGCGCTGTGGAGGAAATTGTGGCTGTGGAACTGT
CAACTGGAGGTCCTGCACATGCAATTCAGGGAAAACCGTGAAAAAGTATCATGAGGTATTACA
GTTTGAGCCTGGCCACATCAAGAGGAGGGGTAGAGCTAAGACCATGGCTCTAGTTGACATCCA
GTTGGATCACCATGAACGATGCGATTGTATCTGCAGCTCAAGACCACCTCGATAAGAGAATGT
GCACATCCTTACATTAAGCCTGAGAGAA

FIGURE 186

MHRLIFVYTLICANFCSCRDTSATPQSASIKALRNANLRRDDLYRRDETIQVKGNGYVQSPRF
PNSYPRNLLLTWRLHSQENTRIQLVFDNQFGLEEAENDICRYDFVEVEDISETSTIIRGRWCG
HKEVPPRIKSRTNQIKITFKSDDYFVAKPGFKIYYSLLEDFQPAAASETNWESVTSSISGVSY
NSPSVTDPTLIADALDKKIAEFDTVEDLLKYFNPESWQEDLENMYLDTPRYRGRSYHDRKSKV
DLDRLNDDAKRYSCTPRNYSVNIREELKLANVVFFPRCLLVQRCGGNCGCGTVNWRSCTCNSG
KTVKKYHEVLQFEPGHIKRRGRAKTMALVDIQLDHHERCDCICSSRPPR

Signal peptide:
amino acids 1-18

N-glycosylation site.
amino acids 270-274 cAMP- and cGMP-dependent protein kinase phosphorylation site.
amino acids 262-266

Tyrosine kinase phosphorylation site.
amino acids 256-265

N-myristoylation sites.
amino acids 94-100, 186-192, 297-303, 298-304

TonB-dependent receptor proteins signature 1.
amino acids 1-56

FIGURE 187

C<u>ATG</u>CCGCTGCCGCCGCTGCTGCTGTTGCTCCTGGCGGCGCCTTGGGGACGGGCAGTTCCCTG
TGTCTCTGGTGGTTTGCCTAAACCTGCAAACATCACCTTCTTATCCATCAACATGAAGAATGT
CCTACAATGGACTCCACCAGAGGGTCTTCAAGGAGTTAAAGTTACTTACACTGTGCAGTATTT
CATATATGGGCAAAAGAAATGGCTGAATAAATCAGAATGCAGAAATATCAATAGAACCTACTG
TGATCTTTCTGCTGAAACTTCTGACTACGACACCAGTATTATGCCAAAGTTAAGGCCATTTG
GGGAACAAAGTGTTCCAAATGGGCTGAAAGTGGACGGTTCTATCCTTTTTTAGAAACACAAAT
TGGCCCACCAGAGGTGGCACTGACTACAGATGAGAAGTCCATTTCTGTTGTCCTGACAGCTCC
AGAGAAGTGGAAGAGAAATCCAGAAGACCTTCCTGTTTCCATGCAACAAATATACTCCAATCT
GAAGTATAACGTGTCTGTGTTGAATACTAAATCAAACAGAACGTGGTCCCAGTGTGTGACCAA
CCACACGCTGGTGCTCACCTGGCTGGAGCCGAACACTCTTTACTGCGTACACGTGGAGTCCTT
CGTCCCAGGGCCCCCTCGCCGTGCTCAGCCTTCTGAGAAGCAGTGTGCCAGGACTTTGAAAGA
TCAATCATCAGAGTTCAAGGCTAAAATCATCTTCTGGTATGTTTTGCCCATATCTATTACCGT
GTTTCTTTTTTCTGTGATGGGCTATTCCATCTACCGATATATCCACGTTGGCAAAGAGAAACA
CCCAGCAAATTTGATTTTGATTTATGGAAATGAATTTGACAAAAGATTCTTTGTGCCTGCTGA
AAAAATCGTGATTAACTTTATCACCCTCAATATCTCGGATGATTCTAAAATTTCTCATCAGGA
TATGAGTTTACTGGGAAAAAGCAGTGATGTATCCAGCCTTAATGATCCTCAGCCCAGCGGGAA
CCTGAGGCCCCCTCAGGAGGAAGAGGAGGTGAAACATTTAGGGTATGCTTCGCATTTGATGGA
AATTTTTTGTGACTCTGAAGAAAACACGGAAGGTACTTCTCTCACCCAGCAAGAGTCCCTCAG
CAGAACAATACCCCCGGATAAAACAGTCATTGAATATGAATATGATGTCAGAACCACTGACAT
TTGTGCGGGGCCTGAAGAGCAGGAGCTCAGTTTGCAGGAGGAGGTGTCCACACAAGGAACATT
ATTGGAGTCGCAGGCAGCGTTGGCAGTCTTGGGCCCGCAAACGTTACAGTACTCATACACCCC
TCAGCTCCAAGACTTAGACCCCCTGGCGCAGGAGCACACAGACTCGGAGGAGGGGCCGGAGGA
AGAGCCATCGACGACCCTGGTCGACTGGGATCCCCAAACTGGCAGGCTGTGTATTCCTTCGCT
GTCCAGCTTCGACCAGGATTCAGAGGGCTGCGAGCCTTCTGAGGGGGATGGGCTCGGAGAGGA
GGGTCTTCTATCTAGACTCTATGAGGAGCCGGCTCCAGACAGGCCACCAGGAGAAAATGAAAC
CTATCTCATGCAATTCATGGAGGAATGGGGGTTATATGTGCAGATGGAAAAC<u>TGA</u>TGCCAACA
CTTCCTTTTGCCTTTTGTTTCCTGTGCAAACAAGTGAGTCACCCCTTTGATCCCAGCCATAAA
GTACCTGGGATGAAAGAAGTTTTTTCCAGTTTGTCAGTGTCTGTGAGAA

FIGURE 188

```
MPLPPLLLLLLAAPWGRAVPCVSGGLPKPANITFLSINMKNVLQWTPPEGLQGVKVTYTVQYF
IYGQKKWLNKSECRNINRTYCDLSAETSDYEHQYYAKVKAIWGTKCSKWAESGRFYPFLETQI
GPPEVALTTDEKSISVVLTAPEKWKRNPEDLPVSMQQIYSNLKYNVSVLNTKSNRTWSQCVTN
HTLVLTWLEPNTLYCVHVESFVPGPPRRAQPSEKQCARTLKDQSSEFKAKIIFWYVLPISITV
FLFSVMGYSIYRYIHVGKEKHPANLILIYGNEFDKRFFVPAEKIVINFITLNISDDSKISHQD
MSLLGKSSDVSSLNDPQPSGNLRPPQEEEEVKHLGYASHLMEIFCDSEENTEGTSLTQQESLS
RTIPPDKTVIEYEYDVRTTDICAGPEEQELSLQEEVSTQGTLLESQAALAVLGPQTLQYSYTP
QLQDLDPLAQEHTDSEEGPEEEPSTTLVDWDPQTGRLCIPSLSSFDQDSEGCEPSEGDGLGEE
GLLSRLYEEPAPDRPPGENETYLMQFMEEWGLYVQMEN
```

Signal sequence:
amino acids 1-18

Transmembrane domain:
amino acids 240-260

N-glycosylation sites.
amino acids 31-34, 72-75, 80-83, 171-174, 180-183, 189-192, 304-307, 523-526

Tyrosine kinase phosphorylation site.
amino acids 385-392, 518-526

N-myristoylation sites.
amino acids 53-58, 106-111, 368-373, 492-497

Tissue factor
amino acids 1-278

FIGURE 189

```
ATGTGCTGCTGGCCGCTGCTCCTGCTGTGGGGGCTGCTCCCCGGGACGGCGGCGGGGGGCTCG
GGCCGAACCTATCCGCACCGGACCCTCCTGGACTCGGAGGGCAAGTACTGGCTGGGCTGGAGC
CAGCGGGGCAGCCAGATCGCCTTCCGCCTCCAGGTGCGCACTGCAGGCTACGTGGGCTTCGGC
TTCTCGCCCACCGGGGCCATGGCGTCCGCCGACATCGTCGTGGGCGGGGTGGCCCACGGGCGG
CCCTACCTCCAGGATTATTTTACAAATGCAAATAGAGAGTTGAAAAAAGATGCTCAGCAAGAT
TACCATCTAGAATATGCCATGGAAAATAGCACACACACAATAATTGAATTTACCAGAGAGCTG
CATACATGTGACATAAATGACAAGAGTATAACGGATAGCACTGTGAGAGTGATCTGGGCCTAC
CACCATGAAGATGCAGGAGAAGCTGGTCCCAAGTACCATGACTCCAATAGGGGCACCAAGAGT
TTGCGGTTATTGAATCCTGAGAAAACTAGTGTGCTATCTACAGCCTTACCATACTTTGATCTG
GTAAATCAGGACGTCCCCATCCCAAACAAAGATACAACATATTGGTGCCAAATGTTTAAGATT
CCTGTGTTCCAAGAAAAGCATCATGTAATAAAGGTTGAGCCAGTGATACAGAGAGGCCATGAG
AGTCTGGTGCACCACATCCTGCTCTATCAGTGCAGCAACAACTTTAACGACAGCGTTCTGGAG
TCCGGCCACGAGTGCTATCACCCCAACATGCCCGATGCATTCCTCACCTGTGAAACTGTGATT
TTTGCCTGGGCTATTGGTGGAGAGGGCTTTTCTTATCCACCTCATGTTGGATTATCCCTTGGC
ACTCCATTAGATCCGCATTATGTGCTCCTAGAAGTCCATTATGATAATCCCACTTATGAGGAA
GGCTTAATAGATAATTCTGGACTGAGGTTATTTTACACAATGGATATAAGGAAATATGATGCT
GGGGTGATTGAGGCTGGCCTCTGGGTGAGCCTCTTCCATACCATCCCTCCAGGGATGCCTGAG
TTCCAGTCTGAGGGTCACTGCACTTTGGAGTGCCTGGAAGAGGCTCTGGAAGCCGAAAAGCCA
AGTGGAATTCATGTGTTTGCTGTTCTTCTCCATGCTCACCTGGCTGGCAGAGGCATCAGGCTG
CGTCATTTTCGAAAAGGGAAGGAAATGAAATTACTTGCCTATGATGATGATTTTGACTTCAAT
TTCCAGGAGTTTCAGTATCTAAAGGAAGAACAAACAATCTTACCAGGAGATAACCTAATTACT
GAGTGTCGCTACAACACGAAAGATAGAGCTGAGATGACTTGGGGAGGACTAAGCACCAGGAGT
GAAATGTGTCTCTCATACCTTCTTTATTACCCAAGAATTAATCTTACTCGATGTGCAAGTATT
CCAGACATTATGGAACAACTTCAGTTCATTGGGGTTAAGGAGATCTACAGACCAGTCACGACC
TGGCCTTTCATTATCAAAAGTCCCAAGCAATATAAAAACCTTTCTTTCATGGATGCTATGAAT
AAGTTTAAATGGACTAAAAAGGAAGGTCTCTCCTTCAACAAGCTGGTCCTCAGCCTGCCAGTG
AATGTGAGATGTTCCAAGACAGACAATGCTGAGTGGTCGATTCAAGGAATGACAGCATTACCT
CCAGATATAGAAAGACCCTATAAAGCAGAACCTTTGGTGTGTGGCACGTCTTCTTCCTCTTCC
CTGCACAGAGATTTCTCCATCAACTTGCTTGTTTGCCTTCTGCTACTCAGCTGCACGCTGAGC
ACCAAGAGCTTGTGATCAAAATTCTGTTGGACTTGACAATGTTTTCTATGATCTGAACCTGTC
ATTTGAAGTACAGGTTAAAGACTGTGTCCACTTTGGGCATGAAGAGTGTGGAGACTTTTCTTC
CCCATTTTCCCTCCCTCCTTTTTCCTTTCCATGTTACATGAGAGACATCAATCAGGTTCTCTT
CTCTTTCTTAGAAATACCTGATGTTATATATACATGGTCAATAAAATAAAACTGGCCTGACTT
AAGATAACCATTTTAAAAAATTGGGCTGTCATGTGGGAATAAAAGAATTCTTTCTTTCCTAAA
AAAAAAA
```

FIGURE 190

```
MCCWPLLLLWGLLPGTAAGGSGRTYPHRTLLDSEGKYWLGWSQRGSQIAFRLQVRTAGYVGFG
FSPTGAMASADIVVGGVAHGRPYLQDYFTNANRELKKDAQQDYHLEYAMENSTHTIIEFTREL
HTCDINDKSITDSTVRVIWAYHHEDAGEAGPKYHDSNRGTKSLRLLNPEKTSVLSTALPYFDL
VNQDVPIPNKDTTYWCQMFKIPVFQEKHHVIKVEPVIQRGHESLVHHILLYQCSNNFNDSVLE
SGHECYHPNMPDAFLTCETVIFAWAIGGEGFSYPPHVGLSLGTPLDPHYVLLEVHYDNPTYEE
GLIDNSGLRLFYTMDIRKYDAGVIEAGLWVSLFHTIPPGMPEFQSEGHCTLECLEEALEAEKP
SGIHVFAVLLHAHLAGRGIRLRHFRKGKEMKLLAYDDDFDFNFQEFQYLKEEQTILPGDNLIT
ECRYNTKDRAEMTWGGLSTRSEMCLSYLLYYPRINLTRCASIPDIMEQLQFIGVKEIYRPVTT
WPFIIKSPKQYKNLSFMDAMNKFKWTKKEGLSFNKLVLSLPVNVRCSKTDNAEWSIQGMTALP
PDIERPYKAEPLVCGTSSSSSLHRDFSINLLVCLLLLSCTLSTKSL
```

Signal peptide:
amino acids 1-18

Transmembrane domains:
amino acids 56-73, 378-393, 583-602

N-glycosylation sites.
amino acids 114-118, 247-251, 476-480, 517-521

N-myristoylation sites.
amino acids 11-17, 15-21, 20-26, 45-51, 68-74, 79-85, 290-296, 316-322, 337-343, 342-348, 456-462, 534-540, 582-588

Copper type II, ascorbate-dependent monooxygenases proteins.
amino acids 271-321, 422-474

FIGURE 191

```
GCTTCAGCTGAAGAAAGAGAGGAATGAAGCGCCTTCTGCTTCTGTTTTTGTTCTTTATAACAT
TTTCTTCTGCATTTCCCTTAGTCCGGATGACGGAAAATGAAGAAAATATGCAACTGGCTCAGG
CATATCTCAACCAGTTCTACTCTCTTGAAATAGAAGGGAATCATCTTGTTCAAAGCAAGAATA
GGAGTCTCATAGATGACAAAATTCGGGAAATGCAAGCATTTTTTGGATTGACAGTGACTGGAA
AACTGGACTCAAACACCCTTGAGATCATGAAGACACCCAGGTGTGGGGTGCCTGATGTGGGCC
AGTATGGCTACACCCTCCCTGGGTGGAGAAAATACAACCTCACCTACAGAATAATAAACTATA
CTCCGGATATGGCACGAGCTGCTGTGGATGAGGCTATCCAAGAAGGTTTAGAAGTGTGGAGCA
AAGTCACTCCACTAAAATTCACCAAGATTTCAAAGGGGATTGCAGACATCATGATTGCCTTTA
GGACTCGAGTCCATGGTCGGTGTCCTCGCTATTTTGATGGTCCCTTGGGAGTGCTTGGCCATG
CCTTTCCTCCTGGTCCGGGTCTGGGTGGTGACACTCATTTTGATGAGGATGAAAACTGGACCA
AGGATGGAGCAGGATTCAACTTGTTTCTTGTGGCTGCTCATGAATTGGTCATGCACTGGGGC
TCTCTCACTCCAATGATCAAACAGCCTTGATGTTCCCAAATTATGTCTCCTGGATCCCAGAA
AATACCCACTTTCTCAGGATGATATCAATGGAATCCAGTCCATCTATGGAGGTCTGCCTAAGG
TACCTGCTAAGCCAAAGGAACCCACTATACCCCATGCCTGTGACCCTGACTTGACTTTTGACG
CTATCACAACTTTCCGCAGAGAAGTAATGTTCTTTAAAGGCAGGCACCTATGGAGGATCTATT
ATGATATCACGGATGTTGAGTTTGAATTAATTGCTTCATTCTGGCCATCTCTGCCAGCTGATC
TGCAAGCTGCATACGAGAACCCCAGAGATAAGATTCTGGTTTTTAAAGATGAAAACTTCTGGA
TGATCAGAGGATATGCTGTCTTGCCAGATTATCCCAAATCCATCCATACATTAGGTTTTCCAG
GACGTGTGAAGAAAATAGATGCAGCCGTCTGTGATAAGACCACAAGAAAAACCTACTTCTTTG
TGGGCATTTGGTGCTGGAGGTTTGATGAAATGACCCAAACCATGGACAAAGGATTCCCGCAGA
GAGTGGTAAAACACTTTCCTGGAATCAGTATCCGTGTTGATGCTGCTTTCCAGTACAAAGGAT
TCTTCTTTTTCAGCCGTGGATCAAAGCAATTTGAATACAACATTAAGACAAAGAATATTACCC
GAATCATGAGAACTAATACTTGGTTTCAATGCAAAGAACCAAAGAACTCCTCATTTGGTTTTG
ATATCAACAAGGAAAAAGCACATTCAGGAGGCATAAAGATATTGTATCATAAGAGTTTAAGCT
TGTTTATTTTTGGTATTGTTCATTTGCTGAAAACACTTCTATTTATCAATAAATTCATAGAC
CTAAAATAAACCTCAACAGGTCTTTTAATATAAATTCTGCTTCAAAATAGAATAAAACCATTC
TTTAACAAC
```

FIGURE 192

MKRLLLLFLFFITFSSAFPLVRMTENEENMQLAQAYLNQFYSLEIEGNHLVQSKNRSLIDDKI
REMQAFFGLTVTGKLDSNTLEIMKTPRCGVPDVGQYGYTLPGWRKYNLTYRIINYTPDMARAA
VDEAIQEGLEVWSKVTPLKFTKISKGIADIMIAFRTRVHGRCPRYFDGPLGVLGHAFPPGPGL
GGDTHFDEDENWTKDGAGFNLFLVAAHEFGHALGLSHSNDQTALMFPNYVSLDPRKYPLSQDD
INGIQSIYGGLPKVPAKPKEPTIPHACDPDLTFDAITTFRREVMFFKGRHLWRIYYDITDVEF
ELIASFWPSLPADLQAAYENPRDKILVFKDENFWMIRGYAVLPDYPKSIHTLGFPGRVKKIDA
AVCDKTTRKTYFFVGIWCWRFDEMTQTMDKGFPQRVVKHFPGISIRVDAAFQYKGFFFFSRGS
KQFEYNIKTKNITRIMRTNTWFQCKEPKNSSFGFDINKEKAHSGGIKILYHKSLSLFIFGIVH
LLKNTSIYQ

Signal peptide:

amino acids 1-17

N-glycosylation sites.

amino acids 55-59, 110-114, 200-204, 452-456, 470-474, 508-512

N-myristoylation site.

amino acids 71-77, 205-211, 223-229

Hemopexin domain signature.

amino acids 171-202, 207-238, 318-334

Neutral zinc metallopeptidases, zinc-binding region signature.

amino acids 213-223

Matrixins cysteine switch.

amino acids 89-97, 207-238

FIGURE 193

CACAATCAGGTCCCATTCTATAGATGGGGAAACTGAGGCTTGAGGTCACATAGGCGTCGTTCA
AGGCTGGTATACCTGCACCCTCTCCCATGTGAACAAC<u>AT</u>G</u>GTTCTGGGTAATGGGGCTGTCA
TCCAGTCTCCTCCCTGCCCCTGCTGGTGCACTTCCTGCCTCTGCTGGTGCACTTTCTGCCCCT
ACTGGTATATTTGCTGCCTCTGCTGGGGCGCTTCCTGCCTCGGCTGGTGTATCTCCTGCCCCT
GCTGGTGCACTTTCTGCCCCGCTGATGCACTTCCTGCCTCTGCTGGTGCACTTCCTGGCTCT
GCTGGCACACTTCCTGCCTCTGCTGGTGCACTTCCTGGCTCTGCTGGCGCACTTTCCTGCCCC
TGCTGGTGTATTTCCTGCCCCTGCTGGTGTACTTCCTTCCCCTGCTGGTGCACTTCCTGCCTC
TGCTGGCGCACTTCTTGCCTCTCCAGGCCCTACC<u>TAG</u>CCTCTCCCTCTTATATATGGAAGTCT
TCCCAGTTCACTGACACTGGTAACAGGGACTCTGCTCTTGGTGTTGCTGTCTGCCCTGGGGAT
GGGCATCTGTGTCTTCCTTTACTACTGCTGGCTCAGGACCCAGAGCTTTGAAGCATGTCCAGA
TGCAGGTCCGGGCACCAGAGTCTAAGGAGCCCCTACACCCACCAGGATTTTCCAATAAAGAGA
TGTTCACCA

FIGURE 194

MVLGNGGCHPVSSLPLLVHFLPLLVHFLPLLVYLLPLLGRFLPRLVYLLPLLVHFLPPLMHFL
PLLVHFLALLAHFLPLLVHFLALLAHFPAPAGVFPAPAGVLPSPAGALPASAGALLASPGPT

Signal peptide:
amino acids 1-39

N-myristoylation sites.
amino acids 4-10, 109-115, 116-122

Leucine zipper pattern.
amino acids 14-36, 16-38, 17-39, 21-43, 24-46, 28-50, 31-53, 35-57, 38-60, 42-64, 45-67, 49-71, 52-74, 56-78, 59-81, 63-85, 65-87, 66-88

FIGURE 195

```
GGCAAGGCGGCGGCGGCGGCGGCAGCCGCGGTGGCGGCGTGGGGAACATCTCGGCAGCCA
CCGCGCTTCTCCCGCTGGAGCGGGCGTCCAGCTTGGCTGCCCTCGGTCCTTCCCTGCCACGTT
TCGGGTCGCCCTGCACCCCCCACCCAGGCTCGCTTCTCTTCGAAGCGGGAAGGGCGCCTTGCA
GGATCCTGCCGCCCCTCCAACCGGATCCTGGGTCTAGAGCTCCCCAGAGCGAGGCGCTCGCCA
GGACTCCTGCCCCGCCAACCCTGACCGCCGGGGGTGCCCCCGGGACGTAGCGCCGCGGAGAG
GAAGCGGCAAAGGGGACCATGCGGCGCCTGACTCGTCGGCTGGTTCTGCCAGTCTTCGGGGTG
CTCTGGATCACGGTGCTGCTGTTCTTCTGGGTAACCAAGAGGAAGTTGGAGGTGCCGACGGGA
CCTGAAGTGCAGACCCCTAAGCCTTCGGACGCTGACTGGGACGACCTGTGGGACCAGTTTGAT
GAGCGGCGGTATCTGAATGCCAAAAAGTGGCGCGTTGGTGACGACCCCTATAAGCTGTATGCT
TTCAACCAGCGGGAGAGTGAGCGGATCTCCAGCAATCGGGCCATCCCGGACACTCGCCATCTG
AGATGCACACTGCTGGTGTATTGCACGGACCTTCCACCCACTAGCATCATCATCACCTTCCAC
AACGAGGCCCGCTCCACGCTGCTCAGGACCATCCGCAGTGTATTAAACCGCACCCCTACGCAT
CTGATCCGGGAAATCATATTAGTGGATGACTTCAGCAATGACCCTGATGACTGTAAACAGCTC
ATCAAGTTGCCCAAGGTGAAATGCTTGCGCAATAATGAACGGCAAGGTCTGGTCCGGTCCCGG
ATTCGGGGCGCTGACATCGCCCAGGGCACCACTCTGACTTTCCTCGACAGCCACTGTGAGGTG
AACAGGGACTGGCTCCAGCCTCTGTTGCACAGGGTCAAAGAGGACTACACGCGGGTGGTGTGC
CCTGTGATCGATATCATTAACCTGGACACCTTCACCTACATCGAGTCTGCCTCGGAGCTCAGA
GGGGGGTTTGACTGGAGCCTCCACTTCCAGTGGGAGCAGCTCTCCCAGAGCAGAAGGCTCGG
CGCCTGGACCCCACGGAGCCCATCAGGACTCCTATCATAGCTGGAGGGCTCTTCGTGATCGAC
AAAGCTTGGTTTGATTACCTGGGGAAATATGATATGGACATGGACATCTGGGGTGGGGAGAAC
TTTGAAATCTCCTTCCGAGTGTGGATGTGCGGGGCAGCCTAGAGATCGTCCCCTGCAGCCGA
GTGGGGCACGTCTTCCGGAAGAAGCACCCCTACGTTTTCCCTGATGGAAATGCCAACACGTAT
ATAAAGAACACCAAGCGGACAGCTGAAGTGTGGATGGATGAATACAAGCAATACTATTACGCT
GCCCGGCCATTCGCCCTGGAGAGGCCCTTCGGGAATGTTGAGAGCAGATTGGACCTGAGGAAG
AATCTGCGCTGCCAGAGCTTCAAGTGGTACCTGGAGAATATCTACCCTGAACTCAGCATCCCC
AAGGAGTCCTCCATCCAGAAGGGCAATATCCGACAGAGACAGAAGTGCCTGGAATCTCAAAGG
CAGAACAACCAAGAAACCCCAAACCTAAAGTTGAGCCCCTGTGCCAAGGTCAAAGGCGAAGAT
GCAAAGTCCCAGGTATGGGCCTTCACATACACCCAGCAGATCCTCCAGGAGGAGCTGTGCCTG
TCAGTCATCACCTTGTTCCCTGGCGCCCCAGTGGTTCTTGTCCTTTGCAAGAATGGAGATGAC
CGACAGCAATGGACCAAAACTGGTTCCCACATCGAGCACATAGCATCCCACCTCTGCCTCGAT
ACAGATATGTTCGGTGATGGCACCGAGAACGGCAAGGAAATCGTCGTCAACCCATGTGAGTCC
TCACTCATGAGCCAGCACTGGGACATGGTGAGCTCTTGAGGACCCCTGCCAGAAGCAGCAAGG
GCCATGGGGTGGTGCTTCCCTGGACCAGAACAGACTGGAAACTGGGCAGCAAGCAGCCTGCAA
CCACCTCAGACATCCTGGACTGGGAGGTGGAGGCAGAGCCCCCAGGACAGGAGCAACTGTCT
CAGGGAGGACAGAGGAAAACATCACAAGCCAATGGGCTCAAAGACAAATCCCACATGTTCTCA
AGGCCGTTAAGTTCCAGTCCTGGCCAGTCATTCCCTGATTGGTATCTGGAGACAGAAACCTAA
TGGGAAGTGTTTATTGTTCCTTTTCCTACAAAGGAAGCAGTCTCTGGAGGCCAGAAAGAAAAG
CCTTCTTTTTCACTAGGCCAGGACTACATTGAGAGATGAAGAATGGAGGTTGTTTCCAAAGA
AATAAAGAGAAACTTAGAAGTTGTCTCTGGAAAAAAAAAAAAAAAAAAAAAAAAAAAAAAAA
AAAAAAAAAAAAAAAAAA
```

FIGURE 196

MRRLTRRLVLPVFGVLWITVLLFFWVTKRKLEVPTGPEVQTPKPSDADWDDLWDQFDERRYLN
AKKWRVGDDPYKLYAFNQRESERISSNRAIPDTRHLRCTLLVYCTDLPPTSIIITFHNEARST
LLRTIRSVLNRTPTHLIREIILVDDFSNDPDDCKQLIKLPKVKCLRNNERQGLVRSRIRGADI
AQGTTLTFLDSHCEVNRDWLQPLLHRVKEDYTRVVCPVIDIINLDTFTYIESASELRGGFDWS
LHFQWEQLSPEQKARRLDPTEPIRTPIIAGGLFVIDKAWFDYLGKYDMDMDIWGGENFEISFR
VWMCGGSLEIVPCSRVGHVFRKKHPYVFPDGNANTYIKNTKRTAEVWMDEYKQYYYAARPFAL
ERPFGNVESRLDLRKNLRCQSFKWYLENIYPELSIPKESSIQKGNIRQRQKCLESQRQNNQET
PNLKLSPCAKVKGEDAKSQVWAFTYTQQILQEELCLSVITLFPGAPVVLVLCKNGDDRQQWTK
TGSHIEHIASHLCLDTDMFGDGTENGKEIVVNPCESSLMSQHWDMVSS

Transmembrane domain:
amino acids 475-493 cAMP- and cGMP-dependent protein kinase phosphorylation site.
amino acids 2-6

Tyrosine kinase phosphorylation sites.
amino acids 68-75, 401-409

N-myristoylation sites.
amino acids 178-184, 186-192, 192-198, 346-352, 383-389, 526-532

FIGURE 197

```
GCAGCTCACCCTTCGCAGCCGCGATGGGGGAAGACGACGCCGCGCTTCGGGCTGGCAGCAGGGGGCTCTCCGACC
CGTGGGCAGACTCAGTGGGAGTGCGACCCCGCACCACGGAGCGCCACATCGCCGTACACAAGCGGTTGTGCTGG
CCTTCGCTGTGTCCCTCGTGGCATTGCTCGCGGTCACAATGCTCGCTGTGCTGCTCAGCCTGCGCTTCGACGAGT
GCGGGGCGAGTGCCACGCCAGGCGCCGACGGTGGCCCCTCAGGCTTTCCGGAGCGCGGCGGCAACGGGAGCCTCC
CTGGATCGGCCCGGCGCAACCACCACGCAGGCGGGGACTCCTGGCAGCCCGAGGCGGGTGGGGTGGCCAGTCCGG
GGACCACGTCGGCCCAGCCGCCGCCGTCGGAGGAGGAGCGGGAGCCGTGGGAGCCGTGGACGCAGCTGCGCCTGTCGG
GCCACCTGAAGCCGCTGCACTACAATCTGATGCTCACCGCCTTCATGGAGAACTTCACCTTCTCCGGGGAGGTCA
ACGTGGAGATCGCGTGCCGGAACGCCACCCGCTACGTAGTGCTGCACGCTTCCCGAGTGGCGGTGGAGAAAGTGC
AGCTGGCCGAGGACCGGGCGTTCGGGGCTGTCCCTGTAGCCGGTTTTTTCCTCTACCCGCAAACCCAGGTCTTAG
TGGTGGTGCTGAATAGGACACTGGACGCGCAGAGGAATTACAATCTGAAGATTATCTACAACGCGCTCATCGAGA
ATGAGCTCCTGGGCTTCTTCCGCAGCTCCTATGTGCTCCACGGGGAGAGAAGATTCCTTGGTGTTACTCAGTTTT
CGCCTACACATGCCAGAAAGGCATTTCCTTGTTTTGATGAGCCAATCTACAAGGCTACTTTCAAAATCAGCATCA
AGCATCAAGCAACCTATTTATCTTTATCTAATATGCCAGTGGAAACTTCCGTGTTTGAGGAAGATGGATGGGTTA
CGGATCACTTTTCACAGACCCCTCTCATGTCCACATATTATTTAGCCTGGGCAATTTGCAACTTCACATACAGAG
AAACTACCACCAAGAGTGGGGTTGTAGTACGATTATATGCAAGACCTGATGCTATCAGAAGAGGATCCGGGGACT
ATGCTCTCCATATAACAAAGAGATTAATAGAATTTTATGAAGACTACTTTAAAGTGCCCTATTCCTTGCCAAAAC
TAGATCTTTTAGCTGTGCCTAAGCATCCGTATGCTGCTATGGAGAACTGGGGACTAAGTATTTTGTGGAACAAA
GAATACTGCTGGATCCCAGTGTTTCATCTATTTCTTATTTGCTGGATGTCACCATGGTCATTGTTCATGAGATAT
GTCACCAGTGGTTTGGTGACCTTGTGACGCCTGTGTGGTGGGAAGACGTGTGGCTGAAGGAAGGGTTTGCTCACT
ACTTTGAATTTGTTGGTACAGACTACCTCTATCCTGGCTGGAACATGGAAAAGCAGAGGTTTCTGACCGATGTTC
TGCATGAAGTGATGCTGCTGGACGGTTTGGCCAGTTCCCATCCAGTATCACAGGAAGTGCTGCAGGCAACAGATA
TTGACAGGGTGTTTGACTGGATCGCATATAAAAAGGGTGCTGCTTTAATAAGAATGCTGGCTAATTTTATGGGCC
ATTCAGTTTTCCAGAGGGGTTTGCAAGATTATTTAACCATTCATAAGTATGGTAATGCAGCCAGAAATGATCTCT
GGAATACATTATCGGAGGCTTTAAAAAGAAATGGGAAATATGTAAATATACAAGAAGTAATGGATCAGTGGACAC
TCCAGATGGGTTATCCTGTTATCACCATCTTGGGAAACACAACAGCAGAAAATAGAATAATAATTACCCAACAGC
ATTTTATCTATGATATCAGTGCTAAAACTAAAGCACTTAAACTTCAGAATAACAGTTACCTGTGGCAGATTCCAT
TAACTATTGTGGTAGGAAATAGAAGCCATGTGTCTTCAGAAGCAATTATTTGGGTGTCTAACAAATCAGAGCACC
ACAGAATAACTTATTTGGACAAAGGAAGCTGGCTGCTGGGGAACATCAATCAAACTGGCTATTTTAGAGTCAACT
ATGACCTAAGGAACTGGAGATTATTAATTGATCAATTAATCCGGAATCATGAGGTTCTTTCTGTCAGTAACCGAG
CGGGCTTGATCGATGATGCCTTCAGCCTAGCCAGGGCTGGCTATTTGCCTCAGAATATTCCTCTGGAGATTATCA
GATACCTGTCTGAGGAGAAGGATTTTCTTCCTGGCATGCTGCCAGCCGAGCTCTTTATCCTCTAGATAAATTAC
TGGACCGCATGGAAAACTACAACATTTTCAATGAATATATTTTAAAGCAAGTTGCAACAACATATATCAAGCTTG
GGTGGCCGAAAAATAATTTTAATGGATCTCTTGTTCAAGCATCCTACCAACATGAAGAACTACGTAGAGAAGTTA
TAATGCTGGCCTGCAGTTTTGGCAACAAGCACTGTCACCAACAGGCATCAACACTTATTTCAGATTGGATTTCCA
GCAACAGGAACAGAATACCACTAAATGTTAGAGACATCGTATACTGTACAGGAGTGTCACTACTGGATGAGGATG
TCTGGGAATTCATATGGATGAAATTCCATTCCACCACAGCAGTTTCTGAGAAGAAAATATTATTGGAAGCCTTAA
CTTGCAGTGATGACAGGAATTTATTAAACAGGCTTCTAAATCTGTCACTGAATTCTGAGGTGGTGCTGGATCAAG
ATGCAATTGATGTCATAATCCATGTAGCTCGAAATCCACATGGTCGAGACCTTGCCTGGAAGTTTTTCAGGGATA
AATGGAAGATATTAAATACCAGGTATGGAGAAGCATTGTTTATGTATTCCAAACTCATCAGTGGTGTCACAGAAT
TTCTTAATACTGAAGGTGAACTCAAAGAGCTCAAGAACTTCATGAAAAACTATGATGGGGTAGCTGCTGCTTCTT
TCTCACGAGCTGTGGAAACTGTCGAAGCCAATGTGCGCTGGAAAATGCTTTACCAAGACGAGCTTTTCCAATGGT
TAGGAAAAGCTCTAAGACACTAATATATGTATCTTATAAACAAACAATTCAACTCAGAAGTTTATGAGAAGACAC
GCTTTTTGTGGAATGAGGAAAATGTACTACCTAGAAAATGGCCAGATTTTCAGTGTTAACGTGTGGGAGGAATTT
TTTTTTTTAGTTTTTATTTTTTGGTTTTGGGGGATATTTTTATTTGTTTCATTCATTCTGTTCTGTTTCTCTAC
TGGGTGTTCCTCTCTAAAGAAACTCTTGCAAGTGAAACTAGCCATGATTGCTTCAGCTGTACATTCCTTGCTGTA
CAGGACCAAATATGATAGTGATGCATGTTGATGTTACAGTCAATTTGGAAAAACATATTCAGAATATCTGTGCAT
GGATATATTGTCCTGCCTGTGTTCCAGCATGCTTATTTCAAACGTCCAGTGTTGTGTGAATATGTGTTACACC
TAGGATGGGCATTATGCAAAAGCACAAAGATTATATATGGCAATCAGTATTGCAATGAAAGAAAAACTAAAAACA
GAAATGATATTCTCAATTTTGGGCAATGTGAGAGGTAAAATAGCCCTTGACATGATGAACATCACTTATTTCAGC
ACTTGGATTGTCTGGCAATGATTACTGTGTTGCTAACTCATTTTCTTTGAGTTAAAGCTGTGTATACATTTTAAA
AGGCATATAGATAGTGTATGCATATGTATATGTACATAGGGAAGCCCCATATGTATATAGTATGTTGTACACTGC
ACATGTACAAAGAATGTCTTCAGATCAAAGAAAATTTATCTCTTTTTATAAACTTAAGGACAGTTGCAAAAGGCT
TCAAGGAATTTATCTCAACATTATTCTTTCTATGTCCTAACTAAATTTCTCAACTGTTATGAATTTTTCATCTAC
TTCTTGAACAGTGGTCTATTCTGCTACATGAAGATGAATACAAACAAAATTTTTGTATAAACTCCCAAAAAAAAA
AAAAAAAAA
```

FIGURE 198

MGEDDAALRAGSRGLSDPWADSVGVRPRTTERHIAVHKRLVLAFAVSLVALLAVTMLAVLLSL
RFDECGASATPGADGGPSGFPERGGNGSLPGSARRNHHAGGDSWQPEAGGVASPGTTSAQPPS
EEEREPWEPWTQLRLSGHLKPLHYNLMLTAFMENFTFSGEVNVEIACRNATRYVVLHASRVAV
EKVQLAEDRAFGAVPVAGFFLYPQTQVLVVVLNRTLDAQRNYNLKIIYNALIENELLGFFRSS
YVLHGERRFLGVTQFSPTHARKAFPCFDEPIYKATFKISIKHQATYLSLSNMPVETSVFEEDG
WVTDHFSQTPLMSTYYLAWAICNFTYRETTTKSGVVVRLYARPDAIRRGSGDYALHITKRLIE
FYEDYFKVPYSLPKLDLLAVPKHPYAAMENWGLSIFVEQRILLDPSVSSISYLLDVTMVIVHE
ICHQWFGDLVTPVWWEDVWLKEGFAHYFEFVGTDYLYPGWNMEKQRFLTDVLHEVMLLDGLAS
SHPVSQEVLQATDIDRVFDWIAYKKGAALIRMLANFMGHSVFQRGLQDYLTIHKYGNAARNDL
WNTLSEALKRNGKYVNIQEVMDQWTLQMGYPVITILGNTTAENRIIITQQHFIYDISAKTKAL
KLQNNSYLWQIPLTIVVGNRSHVSSEAIIWVSNKSEHHRITYLDKGSWLLGNINQTGYFRVNY
DLRNWRLLIDQLIRNHEVLSVSNRAGLIDDAFSLARAGYLPQNIPLEIIRYLSEEKDFLPWHA
ASRALYPLDKLLDRMENYNIFNEYILKQVATTYIKLGWPKNNFNGSLVQASYQHEELRREVIM
LACSFGNKHCHQQASTLISDWISSNRNRIPLNVRDIVYCTGVSLLDEDVWEFIWMKFHSTTAV
SEKKILLEALTCSDDRNLLNRLLNLSLNSEVVLDQDAIDVIIHVARNPHGRDLAWKFFRDKWK
ILNTRYGEALFMYSKLISGVTEFLNTEGELKELKNFMKNYDGVAAASFSRAVETVEANVRWKM
LYQDELFQWLGKALRH

Transmembrane domain:
amino acids 44-63
N-glycosylation sites.
amino acids 89-93, 160-164, 175-179, 222-226, 338-342, 605-609,
634-638, 649-653, 663-667, 684-688, 800-804, 906-910
cAMP- and cGMP-dependent protein kinase phosphorylation site.
amino acids 362-366
Tyrosine kinase phosphorylation site.
amino acids 520-528
N-myristoylation sites.
amino acids 78-84, 87-93, 90-96, 118-124, 501-507, 604-610,
825-831, 987-993
Neutral zinc metallopeptidases, zinc-binding region signature.
amino acids 437-447

FIGURE 199

```
GCGCCCGGCGCAGCTCGGCCAGAGCGACCGCGGGGCTGAGCGCGCGTCCGCCCAGGGGGCTCCGGAAGCTGCCCC
GGCCCGCGGCCTCCTCCCTCGCTCCCGCTTCCCCTTTCTCGCTCACCGCCGCCCTCCTTCCCCAGCTCCCTCGCC
GTCCGCCCGCCCCACAGCCAGCGGCTCCGCGCCCCCTGCAGCCACGATGCCCGCGGCCCGGCCGCCCGCCGCGGG
ACTCCGCGGGATCTCGCTGTTCCTCGCTCTGCTCCTGGGGAGCCCGGCGGCAGCGCTGGAGCGAGATGCTCTTCC
CGAGGGAGATGCTAGCCCTTTGGGTCCTTACCTCCTGCCCTCAGGAGCCCCGGAGAGAGGCAGTCCTGGCAAAGA
GCACCCTGAAGAGAGAGTGGTAACAGCGCCCCCAGTTCCTCACAGTCGGCGGAAGTGCTGGGCGAGCTGGTGCT
GGATGGGACCGCACCCTCTGCACATCACGACATCCCAGCCCTGTCACCGCTGCTTCCAGAGGAGGCCCGCCCCAA
GCACGCCTTGCCCCCCAAGAAGAAACTGCCTTCGCTCAAGCAGGTGAACTCTGCCAGGAAGCAGCTGAGGCCCAA
GGCCACCTCCGCAGCCACTGTCCAAAGGGCAGGGTCCCAGCCAGCGTCCCAGGGCCTAGATCTCCTCTCCTCCTC
CACGGAGAAGCCTGGCCCACCGGGGGACCCGGACCCCATCGTGGCCTCCGAGGAGGCATCAGAAGTGCCCCTTTG
GCTGGATCGAAAGGAGAGTGCGGTCCCTACAACACCCGCACCCTGCAAATCTCCCCCTTCACTTCGCAGCCCTA
TGTGGCCCACACACTCCCCAGAGGCCAGAACCCGGGGAGCCTGGGCCTGACATGGCCCAGGAGGCCCCCCAGGA
GGACACCAGCCCCATGGCCCTGATGGACAAAGGTGAGAATGAGCTGACTGGGTCAGCCTCAGAGGAGAGCCAGGA
GACCACTACCTCCACCATTATCACCACCACGGTCATCACCACCGAGCAAGCACCAGCTCTCTGCAGTGTGAGCTT
CTCCAATCCTGAGGGGTACATTGACTCCAGCGACTACCCACTGCTGCCCCTCAACAACTTTCTGGAGTGCACATA
CAACGTGACAGTCTACACTGGCTATGGGGTGGAGCTCCAGGTGAAGAGTGTGAACCTGTCCGATGGGAACTGCT
CTCCATCCGCGGGGTGGACGGCCCTACCCTGACCGTCCTGGCCAACCAGACACTCCTGGTGGAGGGGCAGGTAAT
CCGAAGCCCCACCAACACCATCTCCGTCTACTTCCGGACCTTCCAGGACGACGCCTTGGGACCTTCCAGCTTCA
CTACCAGGCCTTCATGCTGAGCTGCAACTTTCCCCGCCGGCCTGACTCTGGGGATGTCACGGTGATGGACCTGCA
CTCAGGTGGGGTGGCCCACTTTCACTGCCACCTGGGCTATGAGCTCCAGGGCGCTAAGATGCTGACATGCATCAA
TGCCTCCAAGCCGCACTGGAGCAGCCAGGAGCCCATCTGCTCAGCTCCTTGTGGAGGGGCAGTGCACAATGCCAC
CATCGGCCGCGTCCTCTCCCCAAGTTACCCTGAAAACACAAATGGGAGCCAATTCTGCATCTGGACGATTGAAGC
TCCAGAGGGCCAGAAGCTGCACCTGCACTTTGAGAGGCTGTTGCTGCATGACAAGGACAGGATGACGGTTCACAG
CGGGCAGACCAACAAGTCAGCTCTTCTCTACGACTCCCTTCAAACCGAGAGTGTCCCTTTTGAGGGCCTGCTGAG
CGAAGGCAACACCATCCGCATCGAGTTCACGTCCGACCAGGCCCGGGCGGCCTCCACCTTCAACATCCGATTTGA
AGCGTTTGAGAAAGGCCACTGCTATGAGCCCTACATCCAGAATGGGAACTTCACTACATCCGACCCGACCTATAA
CATTGGGACTATAGTGGAGTTCACCTGCGACCCCGGCCACTCCCTGGAGCAGGGCCCGGCCATCATCGAATGCAT
CAATGTGCGGGACCCATACTGGAATGACACAGAGCCCCTGTGCAGAGCCATGTGTGGTGGGGAGCTCTCTGCTGT
GGCTGGGGTGGTATTGTCCCCAAACTGGCCCGAGCCCTACGTGGAAGGTGAAGATTGTATCTGGAAGATCCACGT
GGGAGAAGAGAAACGGATCTTCTTAGATATCCAGTTCCTGAGCAACAGTGACATCTTGACCATCTACGA
TGGCGACGAGGTCATGCCCCACATCTTGGGGCAGTACCTTGGGAACAGTGGCCCCAGAAACTGTACTCCTCCAC
GCCAGACTTAACCATCCAGTTCCATTCGGACCCTGCTGGCCTCATCTTTGGAAAGGGCCAGGGATTTATCATGAA
CTACATAGAGGTATCAAGGAATGACTCCTGCTCGGATTTACCCGAGATCCAGAATGGCTGGAAAACCACTTCTCA
CACGGAGTTGGTGCGGGGAGCCAGAATCACCTACCAGTGTGACCCCGGCTATGACATCGTGGGGAGTGACACCCT
CACCTGCCAGTGGGACCTCAGCTGGAGCAGCGACCCCCCATTTTGTGAGAAAATTATGTACTGCACCGACCCCGG
AGAGGTGGATCACTCGACCCGCTTAATTTCGGATCCTGTGCTGCTGGTGGGGACCACCATCCAATACACCTGCAA
CCCCGGTTTTGTGCTTGAAGGGAGTTCTCTTCTGACCTGCTACAGCCGTGAAACAGGGACTCCCATCTGGACGTC
TCGCCTGCCCCACTGCGTTTCGGAGGAGTCCCTGGCATGTGACAACCCAGGGCTGCCTGAAATGGATACCAAAT
CCTGTACAAGCGACTCTACCTGCCAGGAGAGTCCCTCACCTTCATGTGCTACGAAGGCTTTGAGCTCATGGGTGA
AGTGACCATCCGCTGCATCCTGGGACAGCCATCCCACTGGAACGGGCCCCTGCCCGTGTGTAAAGTTAATCAAGA
CAGTTTTGAACATGCTTTAGAAGCAGAAGCGGCAGCAGAGACGTCGCTGGAAGGGGGGAACATGGCCCTGGCTAT
CTTCATCCCGGTCCTCATCATCTCCTTACTGCTGGGAGGAGCCTACATTTACATCACAAGATGTCGCTACTATTC
CAACCTCCGCCTGCCTCTGATGTACTCCCACCCCTACAGCCAGATCACCGTGGAAACCGAGTTTGACAACCCCAT
TTACGACACAGGGGAAACCAGAGAGTATGAGGTTTCTATCTAAAGAGAGCTACACTTGAGAAGGGGACTTGTGAA
CTCAACCACAATCTCCTCGAGACATTCATCCAGAGACCATGTGGCACTTGATTGAAACCCCAGAATGTCGACTGT
CTTTTGTTTAGACTCTTTATCAAAGGTTTACTGTTTTCTTCCCTGTATTTATTATATTTAAAAGTGAAAAAAAAA
AAAAAAAAAAA
```

FIGURE 200

MPAARPPAAGLRGISLFLALLLGSPAAALERDALPEGDASPLGPYLLPSGAPERGSPGKEHPE
ERVVTAPPSSSQSAEVLGELVLDGTAPSAHHDIPALSPLLPEEARPKHALPPKKKLPSLKQVN
SARKQLRPKATSAATVQRAGSQPASQGLDLLSSSTEKPGPPGDPDPIVASEEASEVPLWLDRK
ESAVPTTPAPLQISPFTSQPYVAHTLPQRPEPGEPGPDMAQEAPQEDTSPMALMDKGENELTG
SASEESQETTTSTIITTTVITTEQAPALCSVSFSNPEGYIDSSDYPLLPLNNFLECTYNVTVY
TGYGVELQVKSVNLSDGELLSIRGVDGPTLTVLANQTLLVEGQVIRSPTNTISVYFRTFQDDG
LGTFQLHYQAFMLSCNFPRRPDSGDVTVMDLHSGGVAHFHCHLGYELQGAKMLTCINASKPHW
SSQEPICSAPCGGAVHNATIGRVLSPSYPENTNGSQFCIWTIEAPEGQKLHLHFERLLLHDKD
RMTVHSGQTNKSALLYDSLQTESVPFEGLLSEGNTIRIEFTSDQARAASTFNIRFEAFEKGHC
YEPYIQNGNFTTSDPTYNIGTIVEFTCDPGHSLEQGPAIIECINVRDPYWNDTEPLCRAMCGG
ELSAVAGVVLSPNWPEPYVEGEDCIWKIHVGEEKRIFLDIQFLNLSNSDILTIYDGDEVMPHI
LGQYLGNSGPQKLYSSTPDLTIQFHSDPAGLIFGKGQGFIMNYIEVSRNDSCSDLPEIQNGWK
TTSHTELVRGARITYQCDPGYDIVGSDTLTCQWDLSWSSDPPFCEKIMYCTDPGEVDHSTRLI
SDPVLLVGTTIQYTCNPGFVLEGSSLLTCYSRETGTPIWTSRLPHCVSEESLACDNPGLPENG
YQILYKRLYLPGESLTFMCYEGFELMGEVTIRCILGQPSHWNGPLPVCKVNQDSFEHALEAEA
AAETSLEGGNMALAIFIPVLIISLLLGGAYIYITRCRYYSNLRLPLMYSHPYSQITVETEFDN
PIYETGETREYEVSI

Signal peptide:
amino acids 1-28
Transmembrane domain:
amino acids 893-915
N-glycosylation sites.
amino acids 311-315, 328-332, 350-354, 435-439, 458-462, 474-478, 514-518, 576-580, 618-622, 674-678, 742-746
cAMP- and cGMP-dependent protein kinase phosphorylation site.
amino acids 188-192
N-myristoylation sites.
amino acids 23-29, 87-93, 146-152, 454-460, 475-481, 575-581, 629-635, 695-701, 723-729, 766-772, 877-883, 953-959
Prokaryotic membrane lipoprotein lipid attachment site.
amino acids 383-394

FIGURE 201

```
GATGGCTACGGCAGGGGGTGGCTCTGGGGCTGACCCGGGAAGTCGGGGTCTCCTTCGCCTTCT
GTCTTTCTGCGTCCTACTAGCAGGTTTGTGCAGGGGAAACTCAGTGGAGAGGAAGATATATAT
CCCCTTAAATAAAACAGCTCCCTGTGTTCGCCTGCTCAACGCCACTCATCAGATTGGCTGCCA
GTCTTCAATTAGTGGAGACACAGGGGTTATCCACGTAGTAGAGAAAGAGGAGGACCTACAGTG
GGTATTGACTGATGGCCCCAACCCCCCTTACATGGTTCTGCTGGAGAGCAAGCATTTTACCAG
GGATTTAATGGAGAAGCTGAAAGGGAGAACCAGCCGAATTGCTGGTCTTGCAGTGTCCTTGAC
CAAGCCCAGTCCTGCCTCAGGCTTCTCTCCTAGTGTACAGTGCCCAAATGATGGGTTTGGTGT
TTACTCCAATTCCTATGGGCCAGAGTTTGCTCACTGCAGAGAAATACAGTGGAATTCGCTGGG
CAATGGTTTGGCTTATGAAGACTTTAGTTTCCCCATCTTTCTTCTTGAAGATGAAAATGAAAC
CAAAGTCATCAAGCAGTGCTATCAAGATCACAACCTGAGTCAGAATGGCTCAGCACCAACCTT
CCCACTATGTGCCATGCAGCTCTTTTCACACATGCATGCTGTCATCAGCACTGCCACCTGCAT
GCGGCGCAGCTCCATCCAAAGCACCTTCAGCATCAACCCAGAAATCGTCTGTGACCCCTGTC
TGATTACAATGTGTGGAGCATGCTAAAGCCTATAAATACAACTGGACATTAAAGCCTGACGA
CAGGGTTGTGGTTGCTGCCACCCGGCTGGATAGTCGTTCCTTTTTCTGGAATGTGGCCCCAGG
GGCTGAAAGCGCAGTGGCTTCCTTTGTCACCCAGCTGGCTGCTGCTGAAGCTTTGCAAAAGGC
ACCTGATGTGACCACCCTGCCCCGCAATGTCATGTTTGTCTTCTTTCAAGGGGAAACTTTTGA
CTACATTGGCAGCTCGAGGATGGTCTACGATATGGAGAAGGGCAAGTTTCCCGTGCAGTTAGA
GAATGTTGACTCATTTGTGGAGCTGGGACAGGTGGCCTTAAGAACTTCATTAGAGCTTTGGAT
GCACACAGATCCTGTTTCTCAGAAAAATGAGTCTGTACGGAACCAGGTGGAGGATCTCCTGGC
CACATTGGAGAAGAGTGGTGCTGGTGTCCCTGCTGTCATCCTCAGGAGGCCAAATCAGTCCCA
GCCTCTCCCACCATCTTCCCTGCAGCGATTTCTTCGAGCTCGAAACATCTCTGGCGTTGTTCT
GGCTGACCACTCTGGTGCCTTCCATAACAAATATTACCAGAGTATTTACGACACTGCTGAGAA
CATTAATGTGAGCTATCCCGAATGGCTGAGCCCTGAAGAGGACCTGAACTTTGTAACAGACAC
TGCCAAGGCCCTGGCAGATGTGGCCACGGTGCTGGACGTGCTCTGTATGAGCTTGCAGGAGG
AACCAACTTCAGCGACACAGTTCAGGCTGATCCCCAAACGGTTACCCGCCTGCTCTATGGGTT
CCTGATTAAAGCCAACAACTCATGGTTCCAGTCTATCCTCAGGCAGGACCTAAGGTCCTACTT
GGGTGACGGGCCTCTTCAACATTACATCGCTGTCTCCAGCCCCACCAACACCACTTATGTTGT
ACAGTATGCCTTGGCAAATTTGACTGGCACAGTGGTCAACCTCACCCGAGAGCAGTGCCAGGA
TCCAAGTAAAGTCCCAAGTGAAAACAAGGATCTGTATGAGTACTCATGGGTCCAGGGCCCTTT
GCATTCTAATGAGACGGACCGACTCCCCCGGTGTGTGCGTTCTACTGCACGATTAGCCAGGGC
CTTGTCTCCTGCCTTTGAACTGAGTCAGTGGAGCTCTACTGAATACTCTACATGGACTGAGAG
CCGCTGGAAAGATATCCGTGCCCGGATATTTCTCATCGCCAGCAAAGAGCTTGAGTTGATCAC
CCTGACAGTGGGCTTCGGCATCCTCATCTTCTCCCTCATCGTCACCTACTGCATCAATGCCAA
AGCTGATGTCCTTTTCATTGCTCCCCGGGAGCCAGGAGCTGTGTCATACTGAGGAGGACCCCA
GCTTTTCTTGCCAGNTCAGCAGTTCACTTCCTAGAGCATCTGTCCCACTGGGACACAACCACT
AATTTGTCACTGGAACCTCCCTGGGCCTGTCTCAGATTGGGATTAACATAAAAGAGTGGAACT
ATCCAAAAGAGACAGGGAGAAATAAATAAATTGCCTCCCTTCCTCCGCTCCCCTTTCCCATCA
CCCCTTCCCCATTTCCTCTTCCTTCTCTACTCATGCCAGATTTGGGATTACAAATAGAAGCT
TCTTGCTCCTGTTTAACTCCCTAGTTACCCACCCTAATTTGCCCTTCAGGACCCTTCTACTTT
TTCCTTCCTGCCCTGTACCTCTCTCTGCTCCTCACCCCCACCCCTGTACCCAGCCACCTTCCT
GACTGGGAAGGACATAAAAGGTTTAATGTCAGGGTCAAACTACATTGAGCCCCTGAGGACAGG
GGCATCTCTGGGCTGAGCCTACTGTCTCCTTCCCACTGTCCTTTCTCCAGGCCCTCAGATGGC
ACATTAGGGTGGGCGTGCTGCGGGTGGGTATCCCACCTCCAGCCCACAGTGCTCAGTTGTACT
TTTTATTAAGCTGTAATATCTATTTTTGTTTTGTCTTTTTCCTTTATTCTTTTTGTAAATAT
ATATATAATGAGTTTCATTAAAATAGATTATCCC
```

FIGURE 202

MATAGGGSGADPGSRGLLRLLSFCVLLAGLCRGNSVERKIYIPLNKTAPCVRLLNATHQIGCQ
SSISGDTGVIHVVEKEEDLQWVLTDGPNPPYMVLLESKHFTRDLMEKLKGRTSRIAGLAVSLT
KPSPASGFSPSVQCPNDGFGVYSNSYGPEFAHCREIQWNSLGNGLAYEDFSFPIFLLEDENET
KVIKQCYQDHNLSQNGSAPTFPLCAMQLFSHMHAVISTATCMRRSSIQSTFSINPEIVCDPLS
DYNVWSMLKPINTTGTLKPDDRVVVAATRLDSRSFFWNVAPGAESAVASFVTQLAAAEALQKA
PDVTTLPRNVMFVFFQGETFDYIGSSRMVYDMEKGKFPVQLENVDSFVELGQVALRTSLELWM
HTDPVSQKNESVRNQVEDLLATLEKSGAGVPAVILRRPNQSQPLPPSSLQRFLRARNISGVVL
ADHSGAFHNKYYQSIYDTAENINVSYPEWLSPEEDLNFVTDTAKALADVATVLGRALYELAGG
TNFSDTVQADPQTVTRLLYGFLIKANNSWFQSILRQDLRSYLGDGPLQHYIAVSSPTNTTYVV
QYALANLTGTVVNLTREQCQDPSKVPSENKDLYEYSWVQGPLHSNETDRLPRCVRSTARLARA
LSPAFELSQWSSTEYSTWTESRWKDIRARIFLIASKELELITLTVGFGILIFSLIVTYCINAK
ADVLFIAPREPGAVSY

Signal peptide:
amino acids 1-33

Transmembrane domain:
amino acids 671-692

N-glycosylation sites.
amino acids 45-49, 55-59, 187-191, 200-204, 204-208, 264-268,
387-391, 417-421, 435-439, 464-468, 506-510, 530-534, 562-566,
573-577, 580-584, 612-616

Glycosaminoglycan attachment site.
amino acids 404-408 cAMP- and cGMP-dependent protein kinase phosphorylation site.
amino acids 232-236

N-myristoylation site.
amino acids 5-11, 6-12, 9-15, 29-35, 61-67, 120-126, 146-152,
168-174, 205-211, 294-300, 438-444, 446-452, 504-510, 576-582

FIGURE 203

```
GCTAGACCGAGCCCTGGGAGGCTACGGGCTCCCCGGAAACCCTGCCAGGGGAGCCGGGTTTT
GAGCTCAGGCGCCTCTAGCGGCGGCCCCAGAAATCTGACTCGCGAGGCCAGAGTTGCAGGGA
CTGAATAGCAAACTGAGGCTGAGTAGGGAACAGACCATGAGGTCAGTGCAGATCTTCCTCTCC
CAATGCCGTTTGCTCCTTCTACTAGTTCCGACAATGCTCCTTAAGTCTCTTGGCGAAGATGTA
ATTTTTCACCCTGAAGGGGAGTTTGACTCGTATGAAGTCACCATTCCTGAGAAGCTGAGCTTC
CGGGGAGAGGTGCAGGGTGTGGTCAGTCCCGTGTCCTACCTACTGCAGTTAAAAGGCAAGAAG
CACGTCCTCCATTTGTGGCCCAAGAGACTTCTGTTGCCCCGACATCTGCGCGTTTTCTCCTTC
ACAGAACATGGGGAACTGCTGGAGGATCATCCTTACATACCAAGGACTGCAACTACATGGGC
TCCGTGAAAGAGTCTCTGGACTCTAAAGCTACTATAAGCACATGCATGGGGGGTCTCCGAGGT
GTATTTAACATTGATGCCAAACATTACCAAATTGAGCCCCTCAAGGCCTCTCCCAGTTTTGAA
CATGTCGTCTATCTCCTGAAGAAAGAGCAGTTTGGGAATCAGGTTTGTGGCTTAAGTGATGAT
GAAATAGAATGGCAGATGGCCCCTTATGAGAATAAGGCGAGGCTAAGGGACTTTCCTGGATCC
TATAAACACCCAAAGTACTTGGAATTGATCCTACTCTTTGATCAAAGTAGGTATAGGTTTGTG
AACAACAATCTTTCTCAAGTCATACATGATGCCATTCTTTTGACTGGGATTATGGACACCTAC
TTTCAAGATGTTCGTATGAGGATACACTTAAAGGCTCTTGAAGTATGGACAGATTTTAACAAA
ATACGCGTTGGATATCCAGAGTTAGCTGAAGTTTTAGGCAGATTTGTAATATATAAAAAAAGT
GTATTAAATGCTCGCCTGTCATCAGATTGGGCACATTTATATCTTCAAAGAAAATATAATGAT
GCTCTTGCATGGTCGTTTGGAAAAGTGTGTTCTCTAGAATATGCTGGATCAGTGAGTACTTTA
CTAGATACAAATATCCTTGCCCCTGCTACCTGGTCTGCTCATGAGCTGGGTCATGCTGTAGGA
ATGTCACATGATGAACAATACTGCCAATGTAGGGGTAGGCTTAATTGCATCATGGGCTCAGGA
CGCACTGGGTTTAGCAATTGCAGTTATATCTCTTTTTTTAAACATATCTCTTCGGGAGCAACA
TGTCTAAATAATATCCCAGGACTAGGTTATGTGCTTAAGAGATGTGGAAACAAAATTGTGGAG
GACAATGAGGAATGTGACTGTGGTTCCACAGAGGAGTGTCAGAAAGATCGGTGTTGCCAATCA
AATTGTAAGTTGCAACCAGGTGCCAACTGTAGCATTGGACTTTGCTGTCATGATTGTCGGTTT
CGTCCATCTGGATACGTGTGTAGGCAGGAAGGAAATGAATGTGACCTTGCAGAGTACTGCGAC
GGGAATTCAAGTTCCTGCCCAAATGACGTTTATAAGCAGGATGGAACCCCTTGCAAGTATGAA
GGCCGTTGTTTCAGGAAGGGGTGCAGATCCAGATATATGCAGTGCCAAAGCATTTTTGGACCT
GATGCCATGGAGGCTCCTAGTGAGTGCTATGATGCAGTTAACTTAATAGGTGATCAATTTGGT
AACTGTGAGATTACAGGAATTCGAAATTTTAAAAGTGTGAAAGTGCAAATTCAATATGTGGC
AGGCTACAGTGTATAAATGTTGAAACCATCCCTGATTTGCCAGAGCATACGACTATAATTTCT
ACTCATTTACAGGCAGAAAATCTCATGTGCTGGGGCACAGGCTATCATCTATCCATGAAACCC
ATGGGAATACCTGACCTAGGTATGATAAATGATGGCACCTCCTGTGGAGAAGGCCGGGTATGT
TTTAAAAAAAATTGCGTCAATAGCTCAGTCCTGCAGTTTGACTGTTTGCCTGAGAAATGCAAT
ACCCGGGGTGTTTGCAACAACAGAAAAAACTGCCACTGCATGTATGGGTGGGCACCTCCATTC
TGTGAGGAAGTGGGGTATGGAGGAAGCATTGACAGTGGGCCTCCAGGACTGCTCAGAGGGGCG
ATTCCCTCGTCAATTTGGGTTGTGTCCATCATAATGTTTCGCCTTATTTATTAATCCTTTCA
GTGGTTTTTGTGTTTTTCCGGCAAGTGATAGGAAACCACTTAAAACCCAAACAGGAAAAAATG
CCACTATCCAAAGCAAAACTGAACAGGAAGAATCTAAAACAAAACTGTACAGGAAGAATCT
AAAACAAAACTGGACAGGAAGAATCTGAAGCAAAACTGGACAGGAAGAATCTAAAGCAAAA
ACTGGACAGGAAGAATCTAAAGCAAACATTGAAAGTAAACGACCCAAAGCAAAGAGTGTCAAG
AAACAAAAAAAGTAACCGGGCAATCCATACTCATTCAGTAACACAGGCTCATTTATTTAACCA
GCTAATCATTTATCCAAAGGCTTTCCATTCTTCTCCCAATATTTTTTTACTTTAATTTTTCCC
ACAAGTTTTGATCAGCAAATAAACAGCATTCTTGTTTTGGAAACAAAAA
```

FIGURE 204

MRSVQIFLSQCRLLLLLVPTMLLKSLGEDVIFHPEGEFDSYEVTIPEKLSFRGEVQGVVSPVS
YLLQLKGKKHVLHLWPKRLLLPRHLRVFSFTEHGELLEDHPYIPKDCNYMGSVKESLDSKATI
STCMGGLRGVFNIDAKHYQIEPLKASPSFEHVVYLLKKEQFGNQVCGLSDDEIEWQMAPYENK
ARLRDFPGSYKHPKYLELILLFDQSRYRFVNNNLSQVIHDAILLTGIMDTYFQDVRMRIHLKA
LEVWTDFNKIRVGYPELAEVLGRFVIYKKSVLNARLSSDWAHLYLQRKYNDALAWSFGKVCSL
EYAGSVSTLLDTNILAPATWSAHELGHAVGMSHDEQYCQCRGRLNCIMGSGRTGFSNCSYISF
FKHISSGATCLNNIPGLGYVLKRCGNKIVEDNEECDCGSTEECQKDRCCQSNCKLQPGANCSI
GLCCHDCRFRPSGYVCRQEGNECDLAEYCDGNSSSCPNDVYKQDGTPCKYEGRCFRKGCRSRY
MQCQSIFGPDAMEAPSECYDAVNLIGDQFGNCEITGIRNFKKCESANSICGRLQCINVETIPD
LPEHTTIISTHLQAENLMCWGTGYHLSMKPMGIPDLGMINDGTSCGEGRVCFKKNCVNSSVLQ
FDCLPEKCNTRGVCNNRKNCHCMYGWAPPFCEEVGYGGSIDSGPPGLLRGAIPSSIWVVSIIM
FRLILLILSVVFVFFRQVIGNHLKPKQEKMPLSKAKTEQEESKTKTVQEESKTKTGQEESEAK
TGQEESKAKTGQEESKANIESKRPKAKSVKKQKK

Signal peptide:
amino acids 1-27

Transmembrane domain:
amino acids 684-705

N-glycosylation sites.
amino acids 222-226, 372-376, 438-442, 473-477, 625-629

N-myristoylation sites.
amino acids 131-137, 168-174, 235-241, 319-325, 364-370, 436-442, 472-478, 609-615, 642-648, 668-674, 676-680, 680-686, 749-755, 758-764, 767-773

Amidation site.
amino acids 69-73

Disintegrins proteins
amino acids 429-479

EGF-like domain proteins
amino acids 650-662

Neutral zinc metallopeptidases, zinc-binding region proteins
amino acids 335-345

FIGURE 205

CGGACGCGTGGGCGGACGCGTGGGCGGACGCGTGGGGGAAGGTTGAATGGGGTAGAAGGCCTG
TTGTGGAGGGAAACCACCCATCCTCCTGCCTCCCACCACCACCATCATCCTGGCTGGACGGAG
AGGGTGACGGGGGCTGGGAAGGGGCAGCTCATGTTCAGGTTTCCAGGAGGGGCTACCTGTTGA
CTGTCTTTGCAGGAAGAAGAAAACACCTGAGTGACCAGATGTCCCAGCTCCAGGTGCCTTGCC
AGATGGCCAGAACCACACCTCTTGAAGAGTGACAGTGCTGTGGAGCATGGTTTCTGCACACCT
GGAATGACTGGAACCCCAAAGACTCAAGAAGGAGCTAAAGATCTTGAAGTAGACATGAATAAA
ACAGAAGGCTGTGGACCACCTGTCGAGATGGAGAAGTCCTTCTGAGGCTATCCAAACACGGAC
CAGGCCATGAGACCCCGATGACCATCCCTGAATTTTTCGAGAGTCAGTCAACCGATTTGGAA
CTTATCCAGCCCTCCCATCCAAGAATGGCAAAAGTGGGAAATTCTGAATTTCAACCAGTACT
ATGAGGCTTGTCGGAAGGCTGCAAAATCCTTGATCAAGCTGGGTTTGGAGCGTTTCCACGGAG
TTGGTATCCTGGGGTTTAACTCTGCAGAGTGGTTTATCACTGCTGTTGGTGCCATCCTAGCCG
GGGGTCTTTGTGTTGGTATTTATGCCACCAACTCTGCCGAGGCTTGTCAATATGTCATCACTC
ATGCCAAAGTGAACATCTTGCTGGTTGAGAATGATCAACAGTTACAGAAAATCCTTTCGATTC
CACAGAGCAGCCTAGAGCCCCTAAAAGCGATCATCCAGTACAGACTGCCAATGAAGAAGAACA
ACAACTTGTACTCTTGGGATGATTTCATGGAACTTGGCAGAAGTATCCCTGACACCCAACTGG
AGCAGGTCATCGAGAGCCAGAAGGCGAATCAATGCGCAGTGCTCATCTACACTTCAGGGACCA
CAGGCATACCCAAGGGAGTGATGCTCAGTCATGACAACATCACGTGGATTGCAGGAGCAGTGA
CAAAGGACTTTAAACTGACAGACAAGCATGAGACGGTGGTTAGCTACCTCCCACTCAGCCATA
TTGCAGCACAGATGATGGACATCTGGGTACCCATAAAGATTGGGGCGCTCACATACTTTGCTC
AAGCAGATGCTCTCAAGGGCACCTTGGTAAGTACTCTAAAGGAGGTAAAACCTACTGTCTTCA
TTGGAGTGCCTCAAATTTGGGAGAAGATACATGAGATGGTGAAGAAAATAGTGCCAAGTCCA
TGGGCTTGAAGAAGAAGGCATTCGTGTGGGCAAGAAACATTGGCTTCAAGGTCAACTCAAAAA
AGATGTTGGGGAAATATAATACTCCCGTGAGCTACCGCATGGCTAAGACTCTCGTGTTCAGCA
AAGTCAAGACATCCCTTGGCTTGGATCACTGTCACTCTTTTATCAGTGGGACTGCGCCCCTCA
ACCAAGAGACTGCCGAGTTCTTTCTAAGCTTGGACATACCTATAGGCGAGTTGTATGGGTTGA
GTGAGAGCTCGGGACCCCACACGATATCCAACCAGAATAACTACAGGCTTCTAAGCTGTGGCA
AGATCTTGACTGGGTGTAAGAATATGCTGTTCCAGCAGAACAAGGATGGCATTGGGGAGATCT
GCCTCTGGGGTAGGCACATCTTCATGGGCTATCTGGAAAGTGAGACTGAAACTACAGAGGCCA
TCGATGATGAAGGCTGGCTACACTCTGGGGATCTGGGCCAGCTGGACGGTCTGGGTTTCCTCT
ATGTCACCGGCCACATCAAAGAAATCCTTATCACTGCTGGTGGTGAAAATGTGCCCCCATTC
CTGTTGAGACCTTGGTTAAGAAGAAGATCCCCATCATCAGTAACGCCATGTTAGTAGGAGATA
AACTGAAGTTTCTGAGCATGTTGCTGACGCTGAAGTGTGAGATGAATCAGATGAGCGGAGAAC
CTCTGGACAAGCTGAACTTCGAGGCCATCAACTTCTGTCGGGGTCTGGGCAGCCAGGCATCCA
CCGTGACTGAGATTGTGAAGCAGCAAGACCCCCTGGTCTACAAGGCCATCCAGCAAGGCATCA
ATGCTGTGAACCAGGAAGCCATGAACAATGCACAGAGGATTGAAAAGTGGGTCATCTTGGAGA
AGGACTTTTCCATCTATGGTGGAGAGCTAGGTCCAATGATGAAACTTAAGAGACATTTTGTAG
CCCAGAAATACAAAAAACAAATTGATCACATGTACCACTGACTGCTTTGATGGAGCTGCTCTC
AGCTGTTCTGATGCCTTCAGCAGGAAGACCTCATTGCAATAAGTGAAATGCTGCTCTAGGTAG
AAGCTCTCCCTGCTGTTTTTAAGAAGCCACATTCCTCATTGGTCAGTTTCTTGATTGTTCGTC
TGTTGGAGAGGTGCTCCCTAGAAGAACCTGCCATACGTTTCAAAGCAATAAAATCACTGTATA
TCTTTCTAAGGACCTTCAAGTCATGACTCCAGGGAAGCCTATTGGGAAGTCTACTAAAAACTG
CCTGATTTACAAGAAGACCTGAACTTGTGGGCTCCCATTTGATTTTTTCTCCTCAGGGGAC
TCAGACATTAGAAAGAAAAGCCTCACAGATTTGAAGAACTGGACCCCAAATCAACTCACCT
GCCTGGAAGCAACTGGGAAACCCTTCCAATAAGTCCTGATAATAAAGCACTTCAGGGTCCCAA
AAAAAAAAA

FIGURE 206

```
MTIPEFFRESVNRFGTYPALPSKNGKKWEILNFNQYYEACRKAAKSLIKLGLERFHGVGILGF
NSAEWFITAVGAILAGGLCVGIYATNSAEACQYVITHAKVNILLVENDQQLQKILSIPQSSLE
PLKAIIQYRLPMKKNNNLYSWDDFMELGRSIPDTQLEQVIESQKANQCAVLIYTSGTTGIPKG
VMLSHDNITWIAGAVTKDFKLTDKHETVVSYLPLSHIAAQMMDIWVPIKIGALTYFAQADALK
GTLVSTLKEVKPTVFIGVPQIWEKIHEMVKKNSAKSMGLKKKAFVWARNIGFKVNSKKMLGKY
NTPVSYRMAKTLVFSKVKTSLGLDHCHSFISGTAPLNQETAEFFLSLDIPIGELYGLSESSGP
HTISNQNNYRLLSCGKILTGCKNMLFQQNKDGIGEICLWGRHIFMGYLESETETTEAIDDEGW
LHSGDLGQLDGLGFLYVTGHIKEILITAGGENVPPIPVETLVKKKIPIISNAMLVGDKLKFLS
MLLTLKCEMNQMSGEPLDKLNFEAINFCRGLGSQASTVTEIVKQQDPLVYKAIQQGINAVNQE
AMNNAQRIEKWVILEKDFSIYGGELGPMMKLKRHFVAQKYKKQIDHMYH
```

Signal peptide:
amino acids 1-22
Transmembrane domain:
amino acids 65-86
N-glycosylation site.
amino acids 196-200
cAMP- and cGMP-dependent protein kinase phosphorylation site.
amino acids 282-286
Tyrosine kinase phosphorylation sites.
amino acids 547-555, 608-616
N-myristoylation sites.
amino acids 15-21, 74-80, 80-86, 84-90, 185-191, 189-195, 253-259, 337-343, 371-377, 448-454, 536-542
Amidation site.
amino acids 24-28
Putative AMP-binding domain signature.
amino acids 177-189
Putative AMP-binding domain proteins.
amino acids 173-190

FIGURE 207

```
CCCACGCGTCCGCCCACGCGTCCGCGGACGCGTGGGGCCAGATCGCGGCCGGCGCCAGCGCCA
CCGTCCGGTCCACCCGCCAGCCCGCACAGCCGCGCCGCCGCCGAGCGTTTCGTGAGCGGCGCT
CCGAGGATCAGGAATGGGGCTTCGGGCGCTGGGCGCGCTCCGAACCCGGCGCACGTAAGAGCC
TGGGAGCGCCCGAGCCGCCCGGCTGCCCGGAGCCCCATCGCCTAGGACCGGGAGATGCTGGAA
ATGCAACCGCCTGTTCCCCGAGGAGCCGCTGCCCCGGGACCCCTGGCACTGTGCGCACCCT
GGTCAGCAGCCCCGGAGAAGACGGCGCCCCAACGCCCGACCCGCGTGGCCGTGGCAGCGCC
ACGCGAGCCCTCTAGGCGACCGCAGGGCCACAGCAGCTCAGCCGCCGGTGCCCCCTCGGAAAC
CATGACCCCCGGCGCGGGCCCATGGAGCCATGGCCTATAGGGTCCTGGGCCGCGCGGGCCAC
CTCAGCCGCGGAGGGCGCGCAGGCTGCTCTTCGCCTTCACGCTCTCGCTCTCCTGCACTTACC
TGTGTTACAGCTTCCTGTGCTGCTGCGACGACCTGGGTCGGAGCCGCCTCCTCGGCGCGCCTC
GCTGCCTCCGCGGCCCCAGCGCGGGCGGCCAGAAACTTCTCCAGAAGTCCCGCCCCTGTGATC
CCTCCGGGCCGACGCCCAGCGAGCCCAGCGCTCCCAGCGCGCCCGCCGCCGTGCCCGCCC
CTCGCCTCTCCGGTTCCAACCACTCCGGCTCACCCAAGCTGGGTACCAAGCGGTTGCCCCAAG
CCCTCATTGTGGGCGTGAAGAAGGGGGGCACCCGGGCCGTGCTGGAGTTTATCCGAGTACACC
CGGACGTGCGGGCCTTGGGCACGGAACCCCACTTCTTTGACAGGAACTACGGCCGCGGGCTGG
ATTGGTACAGGAGCCTGATGCCCAGGACCCTCGAGAGCCAGATCACGCTGGAGAAGACGCCCA
GCTACTTTGTCACTCAAGAGGCTCCTCGACGCATCTTCAACATGTCCCGAGACACCAAGCTGA
TCGTGGTTGTGCGGAACCCTGTGACCCGTGCCATCTCTGATTACACGCAGACACTCTCCAAGA
AGCCCGACATCCCGACCTTTGAGGGCCTCTCCTTCCGCAACCGCACCCTGGGCCTGGTGGACG
TGTCATGGAACGCCATCCGCATCGGCATGTACGTGCTGCACCTGGAGAGCTGGCTGCAGTACT
TCCCGCTAGCTCAGATTCACTTCGTCAGTGGCGAGCGACTCATCACTGACCCGGCCGGCGAGA
TGGGGCGAGTCCAGGACTTCCTGGGCATTAAGAGATTCATCACGGACAAGCACTTCTATTTCA
ACAAGACCAAAGGATTCCCTTGCTTGAAAAAAACAGAATCGAGCCTCCTGCCTCGATGCTTGG
GCAAATCAAAAGGGAGAACTCATGTACAGATTGATCCTGAAGTGATAGACCAGCTCCGAGAAT
TTTATAGACCGTATAATATCAAATTTTATGAAACCGTTGGGCAGGACTTCAGGTGGGAATAAG
CCCACGAAAGGAAAGGGCTCTCAAGGGCTCTTCTGCTCATCTCTTCCGTGAGATTTGCTCCCA
GACCCTCTGATCTCCCTCCAACAAACCCTGGCTCCAGCCCCCTTTCCCAACTTGAGTTGCATC
ATCTTGGAACCAGGAAGCCCAGCTAAAGCCAAGAGACCAGAGAGTCCCTGCCACTAGTTTTCA
TCAGTCTGTTCAAGCAAAGTTGATCTGCTCCTGGCACGTCCAGTAAATTCCAGAATCATTCTC
CTTTCTGCCCATAAAGGGCCTTGGAGAATTGCTTTAAGAAGAGTGAATGTTCCAATGATGATA
GATATTATAAGCGATGATGGTTCTGTTGCTATGAACACAGCAGTCGGTCCCTGTCATTGTCCA
CCCAGGAGTGGCCTTGTTAATTCCAAGTGGCATGTATCTTCCCTCTGAGCTTCATTTCTTCAA
GATGCTCTGGGTGGTGGGATGGGAGACCATCCTCAGCCCTCCTCAGACCTTATCAATTCATTG
AGAGATTGCAAAGCTGAAAGCACCTCCGGCCACTCCTGGGAGACAGACCCTTTGGTGATGAAA
TAAACCAGTGACTTCAGAGCCTATGGTCTCAACTGTGCTTGAAAAACACTGTCTCTGAAAACA
ACTTTGTGATTCTCCCTGCTCCCTGTGGACAAAAGCACATAATTCTGCTGTTACGGGTACTTT
GCTCATACGAGCTTTCATGTTCAGCATGCAATGGAATCATGCTTGTCCATGTGAAATAAATAT
GGCTCTCTCGTGTCCTTAATGCTGGGCTTTTCTCTGTAAGCTGGTTCTGCAGCACAATTCATT
AATTAAACTTCTCCCAGTGCAAGAAGGCAGCTGGTGCTGGGGGTGGTCTGGGGGGTCAGGGAG
GAGGGCAAGGACTACATGGGGCAGAGGCAAGGCGGTGGTGGAGATGAGGAAAGAAGTTCTTCT
TGGCAGAAGCTGGGGCAGAAAGATCACATGAGATCTGTGGGGACACCCTCTATCTGAAACATA
AGTCTGTGTTCATTCTCTGCTTAGAAATTTTAGATCTGAAGTGCTACACTGAAGGTCCGAAGG
TTGATGGGCATCAGATATCTTTTTGGTTGGCCAGCATGATATTTGAAATAACTGTCAACAG
TTAGAAACTGGGAGCATTCATATGTAAAAAATATGGATTTTCAGCTTCTTCTTAAAAAAAAAA
AAAAAAAAAAAAAAAAAAAAAAAAAAAAAAAAAAAAAAAAAAAAAAAAAAAAAAAAAAAAAA
AAAAAAAAA
```

FIGURE 208

MAYRVLGRAGPPQPRRARRLLFAFTLSLSCTYLCYSFLCCCDDLGRSRLLGAPRCLRGPSAGG
QKLLQKSRPCDPSGPTPSEPSAPSAPAAAVPAPRLSGSNHSGSPKLGTKRLPQALIVGVKKGG
TRAVLEFIRVHPDVRALGTEPHFFDRNYGRGLDWYRSLMPRTLESQITLEKTPSYFVTQEAPR
RIFNMSRDTKLIVVVRNPVTRAISDYTQTLSKKPDIPTFEGLSFRNRTLGLVDVSWNAIRIGM
YVLHLESWLQYFPLAQIHFVSGERLITDPAGEMGRVQDFLGIKRFITDKHFYFNKTKGFPCLK
KTESSLLPRCLGKSKGRTHVQIDPEVIDQLREFYRPYNIKFYETVGQDFRWE

Signal peptide:
amino acids 1-33

N-glycosylation sites.
amino acids 102-106, 193-197, 235-239, 306-310

Tyrosine kinase phosphorylation site.
amino acids 296-305

N-myristoylation sites.
amino acids 51-57, 100-106, 121-127, 125-131

Prokaryotic membrane lipoprotein lipid attachment site.
amino acids 20-31

FIGURE 209

```
CTTTCCTTATCTGTGTGTACTCTTATCTCACTGTTCTATTTTTTCTCCTCATTTATATTAACT
CTTTCTTACCTTTTTTTCTGAACTTCTAGGCCTTCTCTTTCCAGAACTGGTGGAAGACAAATG
AAACGGCCAAGATGGTAAGAAACAAGCCGCATTTCTCCTTGGGGAGACTGATAATTTAAAAGG
TTTGTTGTGTCAGAAACATTCCCAGCTTCATCACCAACCCTTTCCTTCCACCTCTGCCCACTG
GAGACCACTTACATCCCGAAGCGGACGCGGCAGCTGAAGTCAGGAAACCATGCATACATTAG
CAGGAGCCAACTGCAGACTTTAAACTCCGTTCAACATGTGGATGCGGCAGAGAAATGACCTGT
CCAGACAAGCCGGGGCAGCTCATAAACTGGTTCATCTGCTCCCTGTGCGTCCCGCGGGTGCGT
AAGCTCTGGAGCAGCCGGCGTCCAAGGACCCGGAGAAACCTTCTGCTGGGCACTGCGTGTGCC
ATCTACTTGGGCTTCCTGGTGAGCCAGGTGGGGAGGGCCTCTCTCCAGCATGGACAGGCGGCT
GAGAAGGGGCCACATCGCAGCCGCGACACCGCCGAGCCATCCTTCCCTGAGATACCCCTGGAT
GGTACCCTGGCCCCTCCAGAGTCCCAGGGCAATGGGTCCACTCTGCAGCCCAATGTGGTGTAC
ATTACCCTACGCTCCAAGCGCAGCAAGCCGGCCAATATCCGTGGCACCGTGAAGCCCAAGCGC
AGGAAAAAGCATGCAGTGGCATCGGCTGCCCCAGGGCAGGAGGCTTTGGTCGGACCATCCCTT
CAGCCGCAGGAAGCGGCAAGGGAAGCTGATGCTGTAGCACCTGGGTACGCTCAGGGAGCAAAC
CTGGTTAAGATTGGAGAGCGACCCTGGAGGTTGGTGCGGGGTCCGGGAGTGCGAGCCGGGGC
CCAGACTTCCTGCAGCCCAGCTCCAGGGAGAGCAACATTAGGATCTACAGCGAGAGCGCCCCC
TCCTGGCTGAGCAAAGATGACATCCGAAGAATGCGACTCTTGGCGGACAGCGCAGTGGCAGGG
CTCCGGCCTGTGTCCTCTAGGAGCGGAGCCCGTTTGCTGGTGCTGGAGGGGGCGCACCTGGC
GCTGTGCTCCGCTGTGGCCCTAGCCCTGTGGGCTTCTCAAGCAGCCCTTGGACATGAGTGAG
GTGTTTGCCTTCCACCTAGACAGGATCCTGGGGCTCAACAGGACCCTGCCGTCTGTGAGCAGG
AAAGCAGAGTTCATCCAAGATGGCCGCCCATGCCCCATCATTCTTTGGGATGCATCTTTATCT
TCAGCAAGTAATGACACCCATTCTTCTGTTAAGCTCACCTGGGGAACTTATCAGCAGTTGCTG
AAACAGAAATGCTGGCAGAATGGCCGAGTACCCAAGCCTGAATCAGGTTGTACTGAAATACAT
CATCATGAGTGGTCCAAGATGGCACTCTTTGATTTTTGTTACAGATTTATAATCGCTTAGAT
ACAAATTGCTGTGGATTCAGACCTCGCAAGGAAGATGCCTGTGTACAGAATGGATTGAGGCCA
AAATGTGATGACCAAGGTTCTGCGGCTCTAGCACACATTATCCAGCGAAAGCATGACCCAAGG
CATTTGGTTTTTATAGACAACAAGGGTTTCTTTGACAGGAGTGAAGATAACTTAAACTTCAAA
TTGTTAGAAGGCATCAAAGAGTTTCCAGCTTCTGCAGTTTCTGTTTTGAAGAGCCAGCACTTA
CGGCAGAAACTTCTTCAGTCTCTGTTTCTTGATAAAGTGTATTGGGAAAGTCAAGGAGGTAGA
CAAGGAATTGAAAAGCTTATCGATGTAATAGAACACAGAGCCAAAATTCTTATCACCTATATC
AATGCACACGGGTCAAAGTATTACCTATGAATGAATGACAAAAGAATCTTCTGGCTAGGGTG
TTAGATATATTTATGCATTTTTGGTTTTGTTTTAAATCAAGCACATCAACCTCAAGCCCGTT
TAGCAATGAGGCAGTGTAGATGAATACGTAAAATAAATGACTTTAACCAAGTAGCTATAAGG
GACTTAGCACTGTATGCATACTTAAAAAGGTTTTGAAAAACAAACTACTTGAGAAATATTTGT
TTATATTTTTCTCTAACATCATGCTATGTGTCAGTCTGAACATCTGACAACAGAAATTTCAGT
TATTATTCTAGCTAAGTTTTGAAAACATTTGTCATGCTGTTTAATAGAAAACTGCAAACCAGA
GATACTGACTCCATTAATAAACCATATTTTGTGCCGTTTTGACTGTTCTGACCAAATACTAAT
GGGAACAATTCTTGACGTTTTTCTGTTGCTGATTGTTAACATAGAGCAGTCTCTACACTACCC
TGAGGCAACTCTACATTGGAACACTGAGGCTTACAGCCTGCAAGAGCATCAGAGCTGACCATA
CATTTAAACAGAAATGCTGGTTTATTTGCAAAATCACCAGTATATTTCTATTGTGTCTATAA
AAAATCAGTCATTTAAGTACAAGAATCATATTTTCCATTCCTTTTAGAAATTTATTTGTTG
TCCCTATGGAAATCATTCACATCTGACAATTTATATGTTAAAGAGTTTTACTCTCTCTATTTT
GGTCCAATTTGTATCTAGTGGCTGAGAAATTAAATAATTCTAAGTATGAAGTTACCTATCTG
AAAATGTACTTACAGAGTATCATTTTAAAATGGATGTCTCTTTAAAAATTTTGTTACTTTTAC
CAACAATGTAATATAATTTATGTATATTTTATTAATAATAGTGAATTCCTTAAAATTTGTTCT
ATGTACTTATATTTAATTTGATTTAATGGTTACTGCCCAGATATTGAGAAATGGTTCAAATAT
TGAGTGTGTTTCAATAA
```

FIGURE 210

MTCPDKPGQLINWFICSLCVPRVRKLWSSRRPRTRRNLLLGTACAIYLGFLVSQVGRASLQHG
QAAEKGPHRSRDTAEPSFPEIPLDGTLAPPESQGNGSTLQPNVVYITLRSKRSKPANIRGTVK
PKRRKKHAVASAAPGQEALVGPSLQPQEAAREADAVAPGYAQGANLVKIGERPWRLVRGPGVR
AGGPDFLQPSSRESNIRIYSESAPSWLSKDDIRRMRLLADSAVAGLRPVSSRSGARLLVLEGG
APGAVLRCGPSPCGLLKQPLDMSEVFAFHLDRILGLNRTLPSVSRKAEFIQDGRPCPIILWDA
SLSSASNDTHSSVKLTWGTYQQLLKQKCWQNGRVPKPESGCTEIHHHEWSKMALFDFLLQIYN
RLDTNCCGFRPRKEDACVQNGLRPKCDDQGSAALAHIIQRKHDPRHLVFIDNKGFFDRSEDNL
NFKLLEGIKEFPASAVSVLKSQHLRQKLLQSLFLDKVYWESQGGRQGIEKLIDVIEHRAKILI
TYINAHGVKVLPMNE

Transmembrane domain:
amino acids 40-56

N-glycosylation sites.
amino acids 98-102, 289-293, 322-326

N-myristoylation sites.
amino acids 8-14, 41-47, 97-103, 187-193, 251-257, 252-258, 287-293, 484-490

FIGURE 211

```
GTGGGGTGGTGAGCGCAGCGCCGAGGATGAGGAGGTGCAACAGCGGCTCCGGGCCGCCGCCGTCGCTGCTGCTGC
TGCTGCTGTGGCTGCTCGCGGTTCCCGGCGCTAACGCGGCCCCGCGGTCGGCGCTCTATTCGCCTTCCGACCCGC
TGACGCTGCTGCAGGCGGACACGGTGCGCGGCGCGGTGCTGGGCTCCCGCAGCGCCTGGGCCGTGGAGTTCTTCG
CCTCCTGGTGCGGCCACTGCATCGCCTTCGCCCCGACGTGGAAGGCGCTGGCCGAAGACGTCAAAGCCTGGAGGC
CGGCCCTGTATCTCGCCGCCCTGGACTGTGCTGAGGAGACCAACAGTGCAGTCTGCAGAGACTTCAACATCCCTG
GCTTCCCGACTGTGAGGTTCTTCAAGGCCTTTACCAAGAACGGCTCGGGAGCAGTATTTCCAGTGGCTGGTGCTG
ACGTGCAGACGCTGCGGGAGAGGCTCATTGACGCCCTGGAGTCCCATCATGACACGTGGCCCCCAGCCTGTCCCC
CACTGGAGCCTGCCAAGCTGGAGGAGATTGATGGATTCTTTGCGAGAAATAACGAAGAGTACCTGGCTCTGATCT
TTGAAAAGGGAGGCTCCTACCTGGGTAGAGAGGTGGCTCTGGACCTGTCCCAGCACAAAGGCGTGGCGGTGCGCA
GGGTGCTGAACACAGAGGCCAATGTGGTGAGAAAGTTTGGTGTCACCGACTTCCCCTCTTGCTACCTGCTGTTCC
GGAATGGCTCTGTCTCCCGAGTCCCCGTGCTCATGGAATCCAGGTCCTTCTATACCGCTTACCTGCAGAGACTCT
CTGGGCTCACCAGGGAGGCTGCCCAGACCACAGTTGCACCAACCACTGCTAACAAGATAGCTCCCACTGTTTGGA
AATTGGCAGATCGCTCCAAGATCTACATGGCTGACCTGGAATCTGCACTGCACTACATCCTGCGGATAGAAGTGG
GCAGGTTCCCGGTCCTGGAAGGGCAGCGCCTGGTGGCCCTGAAAAAGTTTGTGGCAGTGCTGGCCAAGTATTTCC
CTGGCCGGCCCTTAGTCCAGAACTTCCTGCACTCCGTGAATGAATGGCTCAAGAGGCAGAAGAGAAATAAAATTC
CCTACAGTTTCTTTAAAACTGCCCTGGACGACAGGAAAGAGGGTGCCGTTCTTGCCAAGAAGGTGAACTGGATTG
GCTGCCAGGGGAGTGAGCCGCATTTCCGGGGCTTTCCCTGCTCCCTGTGGGTCCTCTTCCACTTCTTGACTGTGC
AGGCAGCTCGGCAAAATGTAGACCACTCACAGGAAGCAGCCAAGGCCAAGGAGGTCCTCCCAGCCATCCGAGGCT
ACGTGCACTACTTCTTCGGCTGCCGAGACTGCGCTAGCCACTTCGAGCAGATGGCTGCTGCCTCCATGCACCGGG
TGGGGAGTCCCAACGCCGCTGTCCTCTGGCTCTGGTCTAGCCACAACAGGGTCAATGCTCGCCTTGCAGGTGCCC
CCAGCGAGGACCCCCAGTTCCCCAAGGTGCAGTGGCCACCCCGTGAACTTTGTTCTGCCTGCCACAATGAACGCC
TGGATGTGCCCGTGTGGGACGTGGAAGCCACCCTCAACTTCCTCAAGGCCCACTTCTCCCCAAGCAACATCATCC
TGGACTTCCCTGCAGCTGGGTCAGCTGCCCGGAGGGATGTGCAGAATGTGGCAGCCGCCCCAGAGCTGGCGATGG
GAGCCCTGGAGCTGGAAAGCCGGAATTCAACTCTGGACCCTGGGAAGCCTGAGATGATGAAGTCCCCCACAAACA
CCACCCCACATGTGCCGGCTGAGGGACCTGAGGCAAGTCGACCCCCGAAGCTGCACCCTGGCCTCAGAGCTGCAC
CAGGCCAGGAGCCTCCTGAGCACATGGCAGAGCTTCAGAGGAATGAGCAGGAGCAGCCGCTTGGGCAGTGGCACT
TGAGCAAGCGAGACACAGGGGCTGCATTGCTGGCTGAGTCCAGGGCTGAGAAGAACCGCCTCTGGGGCCCTTTGG
AGGTCAGGCGCGTGGGCCGCAGCTCCAAGCAGCTGGTCGACATCCCTGAGGGCCAGCTGGAGGCCCGAGCTGGAC
GGGGCCGAGGCCAGTGGCTGCAGGTGCTGGGAGGGGGCTTCTCTTACCTGGACATCAGCCTCTGTGTGGGGCTCT
ATTCCCTGTCCTTCATGGGCCTGCTGGCCATGTACACCTACTTCCAGGCCAAGATAAGGGCCCTGAAGGGCCATG
CTGGCCACCCTGCAGCCTGAACCACCTGGGGAGGAGGCGGGAGAGGGAGCTGCCATCTCTAGGCACCTCAAGCCC
CCTGACCCCATTCCCTCCCCTCCCACCCCTTGCTCCTTGTCTGGCCTAGAAGTGTGGGAAATTCAGGAAAACGAG
TTGCTCCAGTGAAGCTTCTTGGGGTTGCTAGGACAGAGAGCTCCTTTGACACAAAAGACAGGAGCAGGGTCCAGG
TTCCCCTGCTGTGCAGGGAGGGCAGCCCCGGGCAGTGGGCATAGGGCAGCTCAGTCCCTGGCCTCTTAGCACCAC
ATTCCTGTTTTTCAGCTTATTTGAAGTCCTGCCTCATTCTCACTGGAGCCTCAGTCTCTCCTGCTTGGTCTTGGC
CCTCAACTGGGGCAAGTGAAGCCAGAGGAGGGTCCCCCAGCTGGGTGGGCTGGAATGGAACTCCTACTAGCTGC
TGGGGCTCCGCCCACCCTGCTCCCTTCCGGACAATGAAGAAGCCTTTGCACCCTGGGAGGAAGGACCACCCCGGG
CCCTCTATGCCTGGCCAGCCTCCAGCTCCTCAGACCTCCTGGGTGGGGTTTGGCTTCAGGGTGGGGTTTGGAAGC
TTCTGGAAGTCGTGCTGGTCTCCCAGGTGAGGCAAGCCATGGTTGCTGGGCTGTAGGGTGAGTGGCTTGCTTGGT
GGGACCTGACGAGTTGGTGGCATGGGAAGGATGTGGGTCTCTAGTGCCTTGCCCTGGCTTAGCTGCAGGAGAAGA
TGGCTGCTTTCACTTCCCCCCATTGAGCTCTGCTCCCTCTGAGCCTGGTCTTTTGTCCTTTTTATTTTGGTCTC
CAAGATGAATGCTCATCTTTGGAGGGTGCCAGGTAGAAGCTAGGGAGGGGAGTGTCTTCTCTCTCCAGGTTTCAC
CTTCCAGTGTGCAGAAGTTAGAAGGGTCTGGCGGGGCAGTGCCTTACACATGCTTGATTCCCACGCTACCCCCT
GCCTTGGGAGGTGTGTGGAATAAATTATTTTTGTTAAGGCA
```

FIGURE 212

```
MRRCNSGSGPPPSLLLLLLWLLAVPGANAAPRSALYSPSDPLTLLQADTVRGAVLGSRSAWAV
EFFASWCGHCIAFAPTWKALAEDVKAWRPALYLAALDCAEETNSAVCRDFNIPGFPTVRFFKA
FTKNGSGAVFPVAGADVQTLRERLIDALESHHDTWPPACPPLEPAKLEEIDGFFARNNEEYLA
LIFEKGGSYLGREVALDLSQHKGVAVRRVLNTEANVVRKFGVTDFPSCYLLFRNGSVSRVPVL
MESRSFYTAYLQRLSGLTREAAQTTVAPTTANKIAPTVWKLADRSKIYMADLESALHYILRIE
VGRFPVLEGQRLVALKKFVAVLAKYFPGRPLVQNFLHSVNEWLKRQKRNKIPYSFFKTALDDR
KEGAVLAKKVNWIGCQGSEPHFRGFPCSLWVLFHFLTVQAARQNVDHSQEAAKAKEVLPAIRG
YVHYFFGCRDCASHFEQMAAASMHRVGSPNAAVLWLWSSHNRVNARLAGAPSEDPQFPKVQWP
PRELCSACHNERLDVPVWDVEATLNFLKAHFSPSNIILDFPAAGSAARRDVQNVAAAPELAMG
ALELESRNSTLDPGKPEMMKSPTNTTPHVPAEGPEASRPPKLHPGLRAAPGQEPPEHMAELQR
NEQEQPLGQWHLSKRDTGAALLAESRAEKNRLWGPLEVRRVGRSSKQLVDIPEGQLEARAGRG
RGQWLQVLGGGFSYLDISLCVGLYSLSFMGLLAMYTYFQAKIRALKGHAGHPAA
```

```
Signal peptide:
amino acids 1-29
Transmembrane domain:
amino acids 705-728
N-glycosylation sites.
amino acids 130-134, 243-247, 575-579
Glycosaminoglycan attachment site.
amino acids 6-10
cAMP- and cGMP-dependent protein kinase phosphorylation site.
amino acids 644-648
N-myristoylation sites.
amino acids 52-58, 56-62, 196-202, 381-387, 392-398, 448-454,
468-474, 684-690, 702-708
Cytochrome c family heme-binding site signature.
amino acids 509-515
Thioredoxin family proteins
amino acids 62-78
```

FIGURE 213

```
GCACGAGGCCGACTTCCAGACCATCTACAACTGCACGGCCTGGAACAGCTTCGGCTCCGACAC
TGAGATCATCCGGCTCAAGGAGCAAGGTTCGGAAATGAAGTCGGGAGCCGGGCTGGAAGCAGA
GTCTGTGCCGATGGCCGTCATCATTGGGGTGGCCGTAGGAGCTGGTGTGGCCTTCCTCGTCCT
TATGGCAACCATCGTGGCGTTCTGCTGTGCCCGTTCCCAGAGAAATCTCAAAGGTGTTGTGTC
AGCCAAAAATGATATCCGAGTGGAAATTGTCCACAAGGAACCAGCCTCTGGTCGGGAGGGTGA
GGAGCACTCCACCATCAAGCAGCTGATGATGGACCGGGGTGAATTCCAGCAAGACTCAGTCCT
GAAACAGCTGGAGGTCCTCAAAGAAGAGGAGAAAGAGTTTCAGAACCTGAAGGACCCCACCAA
TGGCTACTACAGCGTCAACACCTTCAAAGAGCACCACTCAACCCCGACCATCTCCCTCTCCAG
CTGCCAGCCCGACCTGCGTCCTGCGGGTAAGCAGCGTGTGCCCACAGGCATGTCCTTCACCAA
CATCTACAGCACCCTGAGCGGCCAGGGCCGCCTCTACGACTACGGGCAGCGGTTTGTGCTGGG
CATGGGCAGCTCGTCCATCGAGCTTTGTGAGCGGGAGTTCCAGAGAGGCTCCCTCAGCGACAG
CAGCTCCTTCCTGGACACGCAGTGTGACAGCAGCGTCAGCAGCAGCGGCAAGCAGGATGGCTA
TGTGCAGTTCGACAAGGCCAGCAAGGCTTCTGCTTCCTCCTCCCACCACTCCCAGTCCTCGTC
CCAGAACTCTGACCCCAGTCGACCCCTGCAGCGGCGGATGCAGACTCACGTCTAAGGATCACA
CACCGCGGGTGGGGACGGGCCAGGGAAGAGGTCAGGGCACGTTCTGGTTGTCCAGGGACGAGG
GGTACTTTGCAGAGGACACCAGAATTGGCCACTTCCAGGACAGCCTCCCAGCGCCTCTGCCAC
TGCCTTCCTTCGAAGCTCTGATCAAGCACAAATCTGGGTCCCCAGGTGCTGTGTGCCAGAGGT
GGGCGGGTGGGGAGACAGACAGAGGCTGCGGCTGAGTGCGCTGTGCTTAGTGCTGGACACCCG
TGTCCCCGGCCCTTTCCTGGAGGCCCCTCTACCACCTGCTCTGCCCACAGGCACAAGTGGCAG
CTATAACTCTGCTTTCATGAAACTGCGGTCCACTCTCTGGTCTCTCTGTGGGCTCTACCCCTC
ACTGACCACAAGCTCTACCTACCCTGTGCCTGTGCTCCCATACAGCCCTGGGGAGAAGGGGA
TGACGTCTTCCCAGCACTGAGCTGCCCCAGAAACCCCGGCTCCCCACTGCTGCTCATAGCCCA
TACCCTGGAGGCTGACAAGCCAGAAATGGCCTTGGCTAAAGGAGCCTCTCTCTCACCAGGCTG
GCCGGGAGCCCACCCCCAATTTGTTTGGTGTTTTGTGTCCATACTCTTGCAGTTCTGTCCTTG
GACTTGATGCCGCTGAACTCTGCGGTGGGACCGGTCCCGTCAGAGCCTGGTGTACTGGGGGGA
GGGAGGGAGGAGGGAGCCTGTGCTGACGGAGCACCTCGCCGGGTGTGCCCCTCCTGGGCTGTG
TGACCCCAGCCTCCCCACCCACCTCCTGCTTTGTGTACTCCTCCCCTCCCCCTCAGCACAATC
GGAGTTCATATAAGAAGTGCGGGAGCTTCTCTGGTCAGGGTTCTCTGAACACTTATGGAGAGA
GTGCTTCCTGGGAAGTGTGGCGTTTGAAGGGGCTGGAGGGCAGGTCTTTAAGATGGCGAGACT
GCCCTTCTCAGCTGATAAACACAAGAACGGCGATCCTGTCTTCAGTAAGGCTCCACGAGAAGA
GAGGAAGTATATCTACACCTCAACCCTCCTAGTCACCACCTGAAATAAATGTTAGGGAAAAAAA
```

FIGURE 214

MAVIIGVAVGAGVAFLVLMATIVAFCCARSQRNLKGVVSAKNDIRVEIVHKEPASGREGEEHS
TIKQLMMDRGEFQQDSVLKQLEVLKEEEKEFQNLKDPTNGYYSVNTFKEHHSTPTISLSSCQP
DLRPAGKQRVPTGMSFTNIYSTLSGQGRLYDYGQRFVLGMGSSSIELCEREFQRGSLSDSSSF
LDTQCDSSVSSSGKQDGYVQFDKASKASASSSHHSQSSSQNSDPSRPLQRRMQTHV

Signal peptide:

amino acids 1-28

Glycosaminoglycan attachment site.

amino acids 150-154

N-myristoylation sites.

amino acids 6-12, 10-16, 36-42, 139-145, 165-171

Prokaryotic membrane lipoprotein lipid attachment site.

amino acids 114-125

FIGURE 215

CAGCCTTCCTCCCCCAGCCTGAGTGACTACTCTATTCCTTGGTCCCTGCTATTGTCGGGGACG
ATTGCATGGGCTACGCCAGGAAAGTAGGCTGGGTGACCGCAGGCCTGGTGATTGGGGCTGGCG
CCTGCTATTGCATTTATAGACTGACTAGGGGAAGAAAACAGAACAAGGAAAAAATGGCTGAGG
GTGGATCTGGGGATGTGGATGATGCTGGGGACTGTTCTGGGGCCAGGTATAATGACTGGTCTG
ATGATGATGATGACAGCAATGAGAGCAAGAGTATAGTATGGTACCCACCTTGGGCTCGGATTG
GGACTGAAGCTGGAACCAGAGCTAGGGCCAGGGCAAGGGCCAGGGCTACCCGGGCACGTCGGG
CTGTCCAGAAACGGGCTTCCCCCAATTCAGATGATACCGTTTTGTCCCCTCAAGAGCTACAAA
AGGTTCTTTGCTTGGTTGAGATGTCTGAAAAGCCTTATATTCTTGAAGCAGCTTTAATTGCTC
TGGGTAACAATGCTGCTTATGCATTTAACAGAGATATTATTCGTGATCTGGGTGGTCTCCCAA
TTGTCGCAAAGATTCTCAATACTCGGGATCCCATAGTTAAGGAAAAGGCTTTAATTGTCCTGA
ATAACTTGAGTGTGAATGCTGAAAATCAGCGCAGGCTTAAAGTATACATGAATCAAGTGTGTG
ATGACACAATCACTTCTCGCTTGAACTCATCTGTGCAGCTTGCTGGACTGAGATTGCTTACAA
ATATGACTGTTACTAATGAGTATCAGCACATGCTTGCTAATTCCATTTCTGACTTTTTTCGTT
TATTTTCAGCGGGAAATGAAGAAACCAAACTTCAGGTTCTGAAACTCCTTTTGAATTTGGCTG
AAAATCCAGCCATGACTAGGGAACTGCTCAGGGCCCAAGTACCATCTTCACTGGGCTCCCTCT
TTAATAAGAAGGAGAACAAAGAAGTTATTCTTAAACTTCTGGTCATATTTGAGAACATAAATG
ATAATTTCAAATGGGAAGAAAATGAACCTACTCAGAATCAATTCGGTGAAGGTTCACTTTTTT
TCTTTTTAAAAGAATTTCAAGTGTGTGCTGATAAGGTTCTGGGAATAGAAAGTCACCATGATT
TTTTGGTGAAAGTAAAAGTTGGAAAATTCATGGCCAAACTTGCTGAACATATGTTCCCAAAGA
GCCAGGAATAACACCTTGATTTGTAATTTAGAAGCAACACACATTGTAAACTATTCATTTTC
TCCACCTTGTTTATATGGTAAAGGAATCCTTTCAGCTGCCAGTTTTGAATAATGAATATCATA
TTGTATCATCAATGCTGATATTTAACTGAGTTGGTCTTTAGGTTTAAGATGGATAAATGAATA
TCACTACTTGTTCTGAAAACATGTTTGTTGCTTTTTATCTCGCTGCCTAGATTGAAATATTTT
GCTATTTCTTCTGCATAAGTGACAGTGAACCAATTCATCATGAGTAAGCTCCCTTCTGTCATT
TTCATTGATTTAATTTGTGTATCATCAATAAAATTGTATGTTAATGCTGGAAAGA

FIGURE 216

MGYARKVGWVTAGLVIGAGACYCIYRLTRGRKQNKEKMAEGGSGDVDDAGDCSGARYNDWSDD
DDDSNESKSIVWYPPWARIGTEAGTRARARARARATRARRAVQKRASPNSDDTVLSPQELQKV
LCLVEMSEKPYILEAALIALGNNAAYAFNRDIIRDLGGLPIVAKILNTRDPIVKEKALIVLNN
LSVNAENQRRLKVYMNQVCDDTITSRLNSSVQLAGLRLLTNMTVTNEYQHMLANSISDFFRLF
SAGNEETKLQVLKLLLNLAENPAMTRELLRAQVPSSLGSLFNKKENKEVILKLLVIFENINDN
FKWEENEPTQNQFGEGSLFFFLKEFQVCADKVLGIESHHDFLVKVKVGKFMAKLAEHMFPKSQE

Signal peptide:
amino acids 1-20

N-glycosylation sites.
amino acids 68-72, 189-193, 217-221, 230-234 cAMP- and cGMP-dependent protein kinase phosphorylation site.
amino acids 107-111

N-myristoylation sites.
amino acids 13-19, 17-23, 19-25, 54-60, 83-89, 147-153, 255-261, 290-296

Amidation site.
amino acids 29-33

FIGURE 217

```
GAGACACAAAGGCAGGCGGGATGCGGGAGCAGGCAAAGGGAAAGCGAAAGCCGCGCGCCCGGC
CGGTGACTGGGTGAAGGCGCCGCGCAGCTTTCCCGACGCCGGCTGTACCCGGACCTCCTGGTC
GAGCCTGGCGCGCCGCAGCCATGGCCATCGCTCAACTGGCCACGGAGTACGTGTTCTCGGATT
TCTTGCTGAAGGAGCCCACGGAGCCCAAGTTCAAGGGGCTGCGACTGGAGCTGGCTGTGGACA
AGATGGTCACGTGCATTGCGGTGGGGCTGCCCCTGCTGCTCATCTCGCTGGCCTTCGCGCAGG
AGATCTCGATTGGTACACAGATAAGCTGTTTCTCTCCAAGTTCTTTCTCCTGGCGTCAGGCTG
CCTTTGTGGATTCATATTGCTGGGCGGCTGTTCAGCAGAAGAACTCACTGCAGAGCGAGTCTG
GAAACCTCCCACTGTGGCTGCATAAGTTTTTCCCCTACATCCTGCTGCTCTTTGCGATCCTCC
TGTACCTGCCCCCGCTGTTCTGGCGTTTCGCAGCTGCTCCTCATATTTGCTCAGACTTGAAGT
TTATCATGGAAGAACTTGACAAAGTTTACAACCGTGCAATTAAGGCTGCAAAGAGTGCGCGTG
ACCTTGACATGAGAGATGGAGCCTGCTCAGTTCCAGGTGTTACCGAGAACTTAGGGCAAAGTT
TGTGGGAGGTATCTGAAAGCCACTTCAAGTACCCAATTGTGGAGCAGTACTTGAAGACAAAGA
AAAATTCTAATAATTTAATCATCAAGTACATTAGCTGCCGCCTGCTGACACTCATCATTATAC
TGTTAGCGTGTATCTACCTGGGCTATTACTTCAGCCTCTCCTCACTCTCAGACGAGTTTGTGT
GCAGCATCAAATCAGGGATCCTGAGAAACGACAGCACCGTGCCCGATCAGTTTCAGTGCAAAC
TCATTGCCGTGGGCATCTTCCAGTTGCTCAGTGTCATTAACCTTGTGGTTTATGTCCTGCTGG
CTCCCGTGGTTGTCTACACGCTGTTTGTTCCATTCCGACAGAAGACAGATGTTCTCAAAGTGT
ACGAAATCCTCCCCACTTTTGATGTTCTGCATTTCAAATCTGAAGGGTACAACGATTTGAGCC
TCTACAATCTCTTCTTGGAGGAAAATATAAGTGAGGTCAAGTCATACAAGTGTCTTAAGGTAC
TGGAGAATATTAAGAGCAGTGGTCAGGGGATCGACCCAATGCTACTCCTGACAAACCTTGGCA
TGATCAAGATGGATGTTGTTGATGGCAAAACTCCCATGTCTGCAGAGATGAGAGAGGAGCAGG
GGAACCAGACGGCAGAGCTCCAAGGTATGAACATAGACAGTGAAACTAAAGCAAATAATGGAG
AGAAGAATGCCCGACAGAGACTTCTGGATTCTTCTTGCTGATGATTTTTTTTCCTTGAGCTGT
AAATCTGTGACTTCTGCGACATGGGATTTAATTTGGCTAAAGCACCCTGTTGGTTTCACAGC
TGGTTTGCAATAAATGGTTCTTGGTGGAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAA
```

FIGURE 218

MAIAQLATEYVFSDFLLKEPTEPKFKGLRLELAVDKMVTCIAVGLPLLLISLAFAQEISIGTQ
ISCFSPSSFSWRQAAFVDSYCWAAVQQKNSLQSESGNLPLWLHKFFPYILLLFAILLYLPPLF
WRFAAAPHICSDLKFIMEELDKVYNRAIKAAKSARDLDMRDGACSVPGVTENLGQSLWEVSES
HFKYPIVEQYLKTKKNSNNLIIKYISCRLLTLIIILLACIYLGYYFSLSSLSDEFVCSIKSGI
LRNDSTVPDQFQCKLIAVGIFQLLSVINLVVYVLLAPVVVYTLFVPFRQKTDVLKVYEILPTF
DVLHFKSEGYNDLSLYNLFLEENISEVKSYKCLKVLENIKSSGQGIDPMLLLTNLGMIKMDVV
DGKTPMSAEMREEQGNQTAELQGMNIDSETKANNGEKNARQRLLDSSC

Transmembrane domains:
amino acids 37-55, 108-126, 216-232, 273-290

N-glycosylation sites.
amino acids 255-259, 338-342, 394-398

Glycosaminoglycan attachment site.
amino acids 357-361 cAMP- and cGMP-dependent protein kinase phosphorylation site.
amino acids 203-207

N-myristoylation sites.
amino acids 61-67, 174-180, 251-257, 393-399

Prokaryotic membrane lipoprotein lipid attachment site.
amino acids 218-229

FIGURE 219

CTGTGAGTGACACACGCTGAGTGGGGTGAAGGGAA<u>ATG</u>CTGGTGAATTTCATTTTGAGGTGTG
GGTTGCTGTTAGTCACTCTGTCTCTTGCCATTGCCAAGCACAAGCAATCTTCCTTCACCAAAA
GTTGTTACCCAAGGGGAACATTGTCCCAAGCTGTTGACGCTCTCTATATCAAAGCAGCATGGC
TCAAAGCAACGATTCCAGAAGACCGCATAAAAATATACGATTATTAAAAAGAAAACAAAAA
AGCAGTTTATGAAAAACTGTCAATTTCAAGAACAGCTTCTGTCCTTCTTCATGGAAGACGTTT
TTGGTCAACTGCAATTGCAAGGCTGCAAGAAAATACGCTTTGTGGAGGACTTTCATAGCCTTA
GGCAGAAATTGAGCCACTGTATTTCCTGTGCTTCATCAGCTAGAGAGATGAAATCCATTACCA
GGATGAAAGAATATTTTATAGGATTGGAAACAAAGGAATCTACAAAGCCATCAGTGAACTGG
ATATTCTTCTTTCCTGGATTAAAAAATTATTGGAAAGCAGTCAG<u>TAA</u>ACCAAAGCCAAGTACA
TTGATTTTACAGTTATTTGAAATACAATAAGAACTGCTAGAAATATGTTTATAACAGTCTAT
TTCTTTTAAAAACTTTTTAACATAATACTGACGGCATGTTAGGTGATTCAGAATAGACAAGAA
GGATTTAGTAAATTAACGTTTTGGATATAAGTTGTCACTAATTTGCACATTTTCTGTGTTTTC
AAATAATGTTTCCATTCTGAACATGTTTTGTCATTCACAAGTACATTGTGTCAACTTAATTTA
AAGTATGTAACCTGAATTAACTCGTGTAATATTTGTGTGTGGAGTGGGATGTGGGGGGTGGAG
GGGGAATGACAGATTTCTGGAATGCAATGTAATGTTACTGAGACTTAAATAGATGTTATGTAT
ATGATTGTCTGTTTAAGTGTTTGAAAATTGTTAATTATGCCCAGTGTGAACTTAGTACTTAAC
ACATTTTGATTTTAATTAAATAAATTGGGTTTCCTTCTCAAAAAAAAAAAAAAAAAAAAAAAA
AAAAA

FIGURE 220

MLVNFILRCGLLLVTLSLAIAKHKQSSFTKSCYPRGTLSQAVDALYIKAAWLKATIPEDRIKN
IRLLKKKTKKQFMKNCQFQEQLLSFFMEDVFGQLQLQGCKKIRFVEDFHSLRQKLSHCISCAS
SAREMKSITRMKRIFYRIGNKGIYKAISELDILLSWIKKLLESSQ

Signal sequence:
amino acids 1-21 cAMP- and cGMP-dependent protein kinase phosphorylation site.
amino acids 68-71

N-myristoylation site.
amino acids 148-153

Interleukin-10 proteins.
amino acids 58-94, 74-102, 128-170

FIGURE 221

```
GACCACGGCCCTGCGCCCCAGCCAGGCCTGAGGACATGAGGCGGCCGGCGGCGGTGCCGCTCC
TGCTGCTGCTGTGTTTTGGGTCTCAGAGGGCCAAGGCAGCAACAGCCTGTGGTCGCCCCAGGA
TGCTGAACCGAATGGTGGGCGGGCAGGACACGCAGGAGGGCGAGTGGCCCTGGCAAGTCAGCA
TCCAGCGCAACGGAAGCCACTTCTGCGGGGGCAGCCTCATCGCGGAGCAGTGGGTCCTGACGG
CTGCGCACTGCTTCCGCAACACCTCTGAGACGTCCCTGTACCAGGTCCTGCTGGGGGCAAGGC
AGCTAGTGCAGCCGGGACCACACGCTATGTATGCCCGGGTGAGGCAGGTGGAGAGCAACCCCC
TGTACCAGGGCACGGCCTCCAGCGCTGACGTGGCCCTGGTGGAGCTGGAGGCACCAGTGCCCT
TCACCAATTACATCCTCCCCGTGTGCCTGCCTGACCCCTCGGTGATCTTTGAGACGGGCATGA
ACTGCTGGGTCACTGGCTGGGGCAGCCCCAGTGAGGAAGACCTCCTGCCCGAACCGCGGATCC
TGCAGAAACTCGCTGTGCCCATCATCGACACACCCAAGTGCAACCTGCTCTACAGCAAAGACA
CCGAGTTTGGCTACCAACCCAAAACCATCAAGAATGACATGCTGTGCGCCGGCTTCGAGGAGG
GCAAGAAGGATGCCTGCAAGGGCGACTCGGGCGGCCCCCTGGTGTGCCTCGTGGGTCAGTCGT
GGCTGCAGGCGGGGGTGATCAGCTGGGGTGAGGGCTGTGCCCGCCAGAACCGCCCAGGTGTCT
ACATCCGTGTCACCGCCCACCACAACTGGATCCATCGGATCATCCCCAAACTGCAGTTCCAGC
CAGCGAGGTTGGGCGGCCAGAAGTGAGACCCCCGGGGCCAGGAGCCCCTTGAGCAGAGCTCTG
CACCCAGCCTGCCCGCCCACACCATCCTGCTGGTCCTCCCAGCGCTGCTGTTGCACCTGTGAG
CCCCACCAGACTCATTTGTAAATAGCGCTCCTTCCTCCCCTCTCAAATACCCTTATTTTATTT
ATGTTTCTCCCAATAAAAACCCAGCCTGTGTGCCAGCTGAAAAAAAAAAAAAAAAAAA
```

FIGURE 222

MRRPAAVPLLLLLCFGSQRAKAATACGRPRMLNRMVGGQDTQEGEWPWQVSIQRNGSHFCGGS
LIAEQWVLTAAHCFRNTSETSLYQVLLGARQLVQPGPHAMYARVRQVESNPLYQGTASSADVA
LVELEAPVPFTNYILPVCLPDPSVIFETGMNCWVTGWGSPSEEDLLPEPRILQKLAVPIIDTP
KCNLLYSKDTEFGYQPKTIKNDMLCAGFEEGKKDACKGDSGGPLVCLVGQSWLQAGVISWGEG
CARQNRPGVYIRVTAHHNWIHRIIPKLQFQPARLGGQK

Important features of the protein:

Signal peptide:

amino acids 1-22

N-glycosylation sites.

amino acids 55-58, 79-82

Casein kinase II phosphorylation sites.

amino acids 121-124, 165-168, 167-170, 248-251

Tyrosine kinase phosphorylation sites.

amino acids 78-86, 197-203

N-myristoylation sites.

amino acids 16-21, 37-42, 56-61, 62-67, 118-123

Amidation site.

amino acids 219-222

Serine proteases, trypsin family, histidine active site.

amino acids 71-76

FIGURE 223

CAAGA<u>ATG</u>TGGACAGCTCTTGTGCTCATTTGGATTTTCTCCTTGTCCTTATCTGAAAGCCATGC
GGCATCCAACGATCCACGCAACTTTGTCCCTAACAAAATGTGGAAGGGATTAGTCAAGAGGAA
TGCATCTGTGGAAACAGTTGATAATAAAACGTCTGAGGATGTAACCATGGCAGCAGCTTCTCC
TGTCACATTGACCAAAGGGACTTCGGCAGCCCACCTCAACTCTATGGAAGTCACAACAGAGGA
CACAAGCAGGACAGATGTGAGTGAACCAGCAACTTCAGGAGTTGCAGCTGATGGTGTGACCTC
CATTGCTCCCACGGCTGTGGCCTCCAGTACGACTGCGGCCTCCATTACGACTGCGGCCTCCAG
TATGACTGTGGCCTCCAGTGCTCCCACGACTGCAGCCTCCAGTACAACTGTGGCCTCCATTGC
TCCCACGACTGCAGCCTCCAGTATGACTGCGGCCTCCAGCACTCCCATGACACTTGCACTCCC
CGCGCCCACGTCCACTTCCACAGGGCGGACCCCGTCCACTACCGCCACTGGGCATCCATCTCT
CAGCACAGCCCTCGCACAAGTGCCAAAGAGCAGCGCGTTGCCAAGAACAGCAACCCTGGCCAC
ATTGGCCACACGTGCTCAGACTGTAGCGACCACAGCAAACACAAGCAGCCCCATGAGCACTCG
TCCAAGTCCTTCCAAGCACATGCCCAGTGACACCGCGGCAAGCCCTGTACCCCCTATGCGTCC
CCAAGCACAAGGTCCCATTAGCCAGGTGTCAGTGGACCAGCCTGTGGTTAACACAACAAATAA
ATCCACACCCATGCCCTCAAACACAACCCCAGAGCCCGCCCCCACCCCACAGTGGTGACCAC
CACCAAGGCACAAGCCAGGGAGCCAACTGCCAGCCCAGTGCCAGTACCTCACACCAGCCCAAT
CCCTGAGATGGAGGCCATGTCCCCCACGACACAGCCAAGCCCATGCCATATACCCAGAGGGC
CGCTGGGCCAGGCACATCCCAGGCACCGGAGCAGGTAGAGACTGAAGCCACACCAGGTACTGA
TTCCACTGGGCCAACACCCAGGAGCTCAGGGGGCACTAAGATGCCAGCCACGGACTCGTGCCA
GCCCAGCACCCAAGGCCAGTACATGGTGGTCACCACTGAGCCCCTCACCCAGGCCGTGGTAGA
CAAAACTCTCCTTCTGGTGGTGCTGTTACTCGGGGTGACCCTTTTCATCACAGTCTTGGTTTT
GTTTGCCCTGCAGGCCTATGAGAGCTACAAGAAGAAGGACTACACCCAGGTGGACTACTTAAT
CAACGGGATGTATGCGGACTCAGAAATG<u>TGA</u>GGGGGGCGGGGCCTGGCGGGAGGCCTGGCCC
CTTCCTCGTCCTTTCCTTTTGCCTTTGAGACCAAACCAAGTGCTTCCAAATTCTTTTGGTGCA
ATTGAGGAGATATGCCAGATGCTTAAACACATTTAATTGCTGTCAGATTAATTCCATGATCAC
TAAAGAGTTGCTGCTTTTTTCATATTTATTTTTGTAAATGATTCTGTGCCCAGGAGCAGCTGG
GGGTTCCACCTCAGGGTGGGGCGGGCAGGACCCCGTCTCCCCAGGTGTCGGAGCCTGACCTGA
ATTAAAGTACTGACTGCTCGCCA

FIGURE 224

MWTALVLIWIFSLSLSESHAASNDPRNFVPNKMWKGLVKRNASVETVDNKTSEDVTMAAASPV
TLTKGTSAAHLNSMEVTTEDTSRTDVSEPATSGVAADGVTSIAPTAVASSTTAASITTAASSM
TVASSAPTTAASSTTVASIAPTTAASSMTAASSTPMTLALPAPTSTSTGRTPSTTATGHPSLS
TALAQVPKSSALPRTATLATLATRAQTVATTANTSSPMSTRPSPSKHMPSDTAASPVPPMRPQ
AQGPISQVSVDQPVVNTTNKSTPMPSNTTPEPAPTPTVVTTTKAQAREPTASPVPVPHTSPIP
EMEAMSPTTQPSPMPYTQRAAGPGTSQAPEQVETEATPGTDSTGPTPRSSGGTKMPATDSCQP
STQGQYMVVTTEPLTQAVVDKTLLLVVLLGVTLFITVLVLFALQAYESYKKKDYTQVDYLIN
GMYADSEM

Signal peptide:

amino acids 1-20

Transmembrane domain:

amino acids 396-420

N-glycosylation sites.

amino acids 41-44, 49-52, 222-225, 268-271, 271-274

Casein kinase II phosphorylation sites.

amino acids 14-17, 51-54, 80-83, 85-88, 280-283, 434-437

N-myristoylation sites.

amino acids 68-73, 354-359

Aldo/keto reductase family putative active site signature.

amino acids 195-210

FIGURE 225

```
GGAAGGCGCTCAAGGTGCGCGGCCCGGGGCGCGCTACTGGGGGCGCCCTCCGCGGTGGGCAGC
GCGCCAGGGATCGGCCTGGGCAGCCGCGGGCGCGCGAAGGCTGCGCTTTCCCTACGGCCCCC
CTCGCTTCCTCCGGCACGGCGGCAACGGAGATTTCCTCTCGGGGAAACTACGCGGATCCTTTT
CGGGGATCCTCGCCCCGCCCCAGTTCTCCGCCCCCTCCCCTTTGCTGGGGCGCCTGGGCTGGC
CCGCGCAGGGGAGGAGGCTCTGGCAGCCTGGGCAGGGAGGCGGCGGGGGGCCGCGGAGCCGCT
GGCCATCGATTCTCCCCGCCATGTGACGCCGTCCTTAGCCCTGCGACCCCAGCGCGTCCCGG
GCCTGCGCCTCCGCCCCGCCGCGCAGCGCACGATGCTTCTGCCGGGACGCGCACGCCAACCGC
CGACGCCCAGCCCGTGCAGCATCCCGGCCTCCGCCGGCAGGTAGAGCCGCCGGGGCAGCTCC
TGCGCCTCTTCTACTGCACTGTCCTGGTCTGCTCCAAAGAGATCTCAGCGCTCACCGACTTCT
CTGGTTACCTAACCAAACTCCTGCAAAACCACACCACCTATGCCTGTGATGGGGACTATTTGA
ATCTACAGTGCCCTCGGCATTCTACGATAAGTGTCCAATCGGCATTTTATGGGCAAGATTACC
AAATGTGTAGTTCCCAGAAGCCTGCCTCCCAGAGGGAAGACAGCTTAACCTGTGTGGCAGCCA
CCACCTTCCAGAAGGTGCTGGACGAATGCCAGAACCAGCGGGCCTGCCACCTCCTGGTCAATA
GCCGTGTTTTTGGACCTGACCTTTGTCCAGGAAGCAGTAAATACCTCCTGGTCTCCTTTAAAT
GCCAACCTAATGAATTAAAAAACAAAACCGTGTGTGAAGACCAGGAGCTGAAACTGCACTGCC
ATGAATCCAAGTTCCTCAACATCTACTCTGCGACCTACGGCAGGAGGACCCAGGAAAGGGACA
TCTGCTCCTCCAAGGCAGAGCGGCTCCCCCCTTTCGATTGCTTGTCTTACTCAGCTTTGCAAG
TCCTATCCCGAAGGTGCTATGGGAAGCAGAGATGCAAAATCATCGTCAACAATCACCATTTTG
GAAGCCCCTGTTTGCCAGGCGTGAAAAAATACCTCACTGTGACCTACGCATGTGTTCCCAAGA
ACATACTCACAGCGATTGATCCAGCCATTGCTAATCTAAAACCTTCTTTGAAGCAGAAAGATG
GTGAATATGGTATAAACTTCGACCCAAGCGGATCGAAGGTTCTGAGGAAAGATGGAATTCTTG
TTAGCAACTCTCTGGCAGCCTTTGCTTACATTAGAGCCCACCCAGAGAGAGCTGCCCTGCTGT
TCGTGTCCAGTGTCTGCATCGGCCTGGCCCTCACACTGTGCGCCCTGGTCATCAGAGAGTCCT
GTGCCAAGGACTTCCGCGACTTGCAGCTGGGGAGGGAGCAGCTGGTGCCAGGAAGTGACAAGG
TCGAGGAGGACAGCGAGGATGAAGAAGAGGAGGAGGACCCCTCTGAGTCTGATTTCCCAGGGG
AACTGTCGGGGTTCTGTAGGACTTCATATCCTATATACAGTTCCATAGAAGCTGCAGAGCTCG
CAGAAAGGATTGAGCGCAGGGAGCAAATCATTCAGGAAATATGGATGAACAGTGGTTTGGACA
CCTCGCTCCCAAGAAACATGGGCCAGTTCTACTGAAAACCACATGCATCTTGATGCGATCGCA
CTTTCTGAAGAAGGAAGGATCCCAAATGCCCTCCAGTTCTGGTTCACCTGTACCTTCTATGA
AGGAGAATTCGTCATGTCATTCAACACTCGTGAGGCCAGGAAGCTATTAAAGGGATGTTTCAA
GCTGTTTCTAGCACATTCCAAAATAAATGAGGAGGGAGGAAAAAAAAAAAAAAAAAAAAAAA
AAAAAAAAAAAAAAAAA
```

FIGURE 226

MLLPGRARQPPTPQPVQHPGLRRQVEPPGQLLRLFYCTVLVCSKEISALTDFSGYLTKLLQNH
TTYACDGDYLNLQCPRHSTISVQSAFYGQDYQMCSSQKPASQREDSLTCVAATTFQKVLDECQ
NQRACHLLVNSRVFGPDLCPGSSKYLLVSFKCQPNELKNKTVCEDQELKLHCHESKFLNIYSA
TYGRRTQERDICSSKAERLPPFDCLSYSALQVLSRRCYGKQRCKIIVNNHHFGSPCLPGVKKY
LTVTYACVPKNILTAIDPAIANLKPSLKQKDGEYGINFDPSGSKVLRKDGILVSNSLAAFAYI
RAHPERAALLFVSSVCIGLALTLCALVIRESCAKDFRDLQLGREQLVPGSDKVEEDSEDEEEE
EDPSESDFPGELSGFCRTSYPIYSSIEAAELAERIERREQIIQEIWMNSGLDTSLPRNMGQFY

Transmembrane domains:

amino acids 32-49, 322-343

N-glycosylation sites.

amino acids 62-66, 165-169

Tyrosine kinase phosphorylation site.

amino acids 280-287

N-myristoylation site.

amino acids 302-308, 333-339, 428-434

Amidation site.

amino acids 191-195

FIGURE 227

GGCACGAGGTGGAAGGGCTTTTACAAACAGATTGCTGGCCCCACCCCCCAGAATTTCTCATCA
GGAGTGGGCAAGACCAATCATTTGCATTTCTGACAAGTTCCCAGGAGCTGCAGCTGCTGGCCC
TGGAACCACACTTTGAGAACCACTGCTTTAGACCAAACACCAAAGGAAGATGCAGCCACCCTC
CTTTACATGTCACAACGCTCAGGGTCCATGAGTACCTCAGGCTGTCCAGCTGAGCTCCACCTG
CAGCAGCCGAGATTCCCGACTCGCTCCACCATTGGGGGCTAGGAGTGAAGCGTGTCACC<u>ATGG</u>
TCAGCTCATGGCCAGCCAGGAAAGCCTCTCTGCTGTGCGTCTGTGCAGTTCTTGTTCTTCCCT
GGAGGACTCTTGGATCGCCTGTGATCTTGGCCAGGAGACCAGGTGCCTGGGTCCCTTCCTGGA
AGGGGACAAGTTACACACCCCAGCCCCATTTTCCCACCAACTTCTACATGCCTTGGGAGAACC
TTCTACATGTTGGCTGCCCCCTTCCCCTATTTCAGCAGTGCCCAGTCCTGCTTATAAACCTGA
GGCCTGCTCCCCATACCTTCCCTGTGCAAGTGCCAGCCGTTATTCCAGGCAGCCCAATGTTGT
TGAGGCCAGATGGATTCCTGGAAGCAGCTGGCCCATGGATG<u>TGA</u>GTCATCACAGTATTCTAGA
AACAGAGAAGAGGTCTTAACCTAATGCGCATAGAGAAATTGTTCTCATTGTAAACATACCCCT
GTCCTTAGCTGATCTAGGTGGAAGCCCAGCTTCATGTGCTAGGGGGCATGATAATGATAATAA
AGGAATTGTATCTAGGACTAA

FIGURE 228

MVSSWPARKASLLCVCAVLVLPWRTLGSPVILARRPGAWVPSWKGTSYTPQPHFPTNFYMPWE
NLLHVGCPLPLFQQCPVLLINLRPAPHTFPVQVPAVIPGSPMLLRPDGFLEAAGPWM

Signal peptide:
amino acids 1-27 cAMP- and cGMP-dependent protein kinase phosphorylation site.
amino acids 8-12

FIGURE 229

```
GGGAAGGGATGCAAGGAAGCCCTCCGGCGCTGCGCTCCGAGGCGGGAGACAGCGTCCCGCTGA
AAATGTGTGTCTGACATGCAAGCTCAGTGGGGCAGAGACCCGTGGATTGCTGTGCCCTGCCCT
CCGGACCTGGATCATGAAGGTGTTGGGAAGAAGCTTCTTCTGGGTGCTGTTTCCCGTCCTTCC
CTGGGCGGTGCAGGCTGTGGAGCACGAGGAGGTGGCGCAGCGTGTGATCAAACTGCACCGCGG
GCGAGGGGTGGCTGCCATGCAGAGCCGGCAGTGGGTCCGGGACAGCTGCAGGAAGCTCTCAGG
GCTTCTCCGCCAGAAGAATGCAGTTCTGAACAAACTGAAAACTGCAATTGGAGCAGTGGAGAA
AGACGTGGGCCTGTCGGATGAAGAGAAACTGTTTCAGGTGCACACGTTTGAAATTTTCCAGAA
AGAGCTGAATGAAAGTGAAAATTCCGTTTTCCAAGCTGTCTACGGACTGCAGAGAGCCCTGCA
GGGGGATTACAAAGATGTCGTGAACATGAAGGAGAGCAGCCGGCAGCGCCTGGAGGCCCTGAG
AGAGGCTGCAATAAAGGAAGAAACAGAATATATGGAACTTCTGGCAGCAGAAAAACATCAAGT
TGAAGCCCTTAAAAATATGCAACATCAAAACCAAAGTTTATCCATGCTTGACGAGATTCTTGA
AGATGTAAGAAAGGCAGCGGATCGTCTGGAGGAAGAGATAGAGGAACATGCTTTTGACGACAA
TAAATCAGTCAAGGGGGTCAATTTTGAGGCAGTTCTGAGGGTGGAGGAAGAAGAGGCCAATTC
TAAGCAAAATATAACAAAACGAGAAGTGGAGGATGACTTGGGTCTTAGCATGCTGATTGACTC
CCAGAACAACCAGTATATTTTGACCAAGCCCAGAGATTCAACCATCCCACGTGCAGATCACCA
CTTTATAAAGGACATTGTTACCATAGGAATGCTGTCCTTGCCTTGTGGCTGGCTATGTACAGC
CATAGGATTGCCTACAATGTTTGGTTATATTATTTGTGGTGTACTTCTGGGACCTTCAGGACT
AAATAGTATTAAGTCTATTGTGCAAGTGGAGACATTAGGAGAATTTGGGGTGTTTTTTACTCT
TTTTCTTGTTGGCTTAGAATTTTCTCCAGAAAAGCTAAGAAAGGTGTGGAAGATTTCCTTACA
AGGGCCGTGTTACATGACACTGTTAATGATTGCATTTGGCTTGCTGTGGGGCATCTCTTGCG
GATCAAACCCACGCAGAGCGTCTTCATTTCCACGTGTCTGTCCTTGTCAAGCACACCCCTCGT
GTCCAGGTTCCTCATGGGCAGTGCTCGGGGTGACAAAGAAGGCGACATTGACTACAGCACCGT
GCTCCTCGGCATGCTGGTGACGCAGGACGTGCAGCTCGGGCTCTTCATGGCCGTCATGCCGAC
TCTCATACAGGCGGGCGCCAGTGCATCTTCTAGCATTGTCGTGGAAGTTCTCCGAATCCTGGT
TTTGATTGGTCAGATTCTTTTTTCACTAGCGGCGGTTTTTCTTTTATGTCTTGTTATAAAGAA
GTATCTCATTGGACCCTATTATCGGAAGCTGCACATGGAAAGCAAGGGGAACAAAGAAATCCT
GATCTTGGGAATATCTGCCTTTATCTTCTTAATGTTAACGGTCACGGAGCTGCTGGACGTCTC
CATGGAGCTGGGCTGTTTCCTGGCTGGAGCGCTCGTCTCCTCTCAGGGCCCCGTGGTCACCGA
GGAGATCGCCACCTCCATCGAACCCATCCGCGACTTCCTGGCCATCGTTTTCTTCGCCTCCAT
AGGGCTCCACGTGTTCCCCACGTTTGTGGCGTACGAGCTCACGGTGCTGGTGTTCCTCACCTT
GTCAGTGGTGGTGATGAAGTTTCTCCTGGCGGCGCTGGTCCTGTCTCTCATTCTGCCGAGGAG
CAGCCAGTACATCAAGTGGATCGTCTCTGCGGGCTTGCCCAGGTCAGCGAGTTTTCCTTTGT
CCTGGGGAGCCGGGCGCGAAGAGCGGGCGTCATCTCTCGGGAGGTGTACCTCCTTATACTGAG
TGTGACCACGCTCAGCCTCTTGCTCGCCCCGGTGCTGTGGAGAGCTGCAATCACGAGGTGTGT
GCCCAGACCGGAGAGACGGTCCAGCCTCTGATGGCTCGGAGATGATGGACCGTGGAAGGGAAG
CGTCTGTGGGGAGTGAGCGCTTAGATGGCCAGCAGCTGCTCCTTCTGGGAAGCTCGCACCTTG
GCAACAGAACAGCCCTCTAGCAGAGCGTCAGTGCAGTCGTGTTATCCCGGCTTTTACAGAATA
TTCTTGTCCTATTTTAGAATTTTCCGGAGTAGTTTATTTGCAGTCTGTTGATTATGTGCAGTA
GACCCGGGACACTGCGTTTTACCGATCACCTTGAATGTGGTGCCTGGATGTGCCTTTTTTTTT
TTTCCCTGAAATTATTATTAATTTTCTATTGTGAGTTCATCAGTTCATAGTTTTTTTAGTAAA
GAAGCAAAATTAAAAGGCTTTTAAAAATGTACAACTTCAGAATTATAATCTGTTAGTCAAATA
TTTGTTATTAAACATTTCTGTAATATGAAGTTGTAATCCTGGCCGTGAGCTTGGAAGCTTACT
TTTGATTCTTAAAGCCTATGTTTTCTAAAATGAGACAAATACGGATGTCTATTTGCCTTTTAT
TGTAACTTTTAAATGAAATAATTTCATGTCAATTTCTATTAGATATATCACTTAAAATATTTG
GTTTTAAATCACAAGAATATGTATTCTTTAATAAAGATAATTTATGATCATGGTAAAAAAAAAA
```

FIGURE 230

```
MKVLGRSFFWVLFPVLPWAVQAVEHEEVAQRVIKLHRGRGVAAMQSRQWVRDSCRKLSGLLRQ
KNAVLNKLKTAIGAVEKDVGLSDEEKLFQVHTFEIFQKELNESENSVFQAVYGLQRALQGDYK
DVVNMKESSRQRLEALREAAIKEETEYMELLAAEKHQVEALKNMQHQNQSLSMLDEILEDVRK
AADRLEEEIEEHAFDDNKSVKGVNFEAVLRVEEEEANSKQNITKREVEDDLGLSMLIDSQNNQ
YILTKPRDSTIPRADHHFIKDIVTIGMLSLPCGWLCTAIGLPTMFGYIICGVLLGPSGLNSIK
SIVQVETLGEFGVFFTLFLVGLEFSPEKLRKVWKISLQGPCYMTLLMIAFGLLWGHLLRIKPT
QSVFISTCLSLSSTPLVSRFLMGSARGDKEGDIDYSTVLLGMLVTQDVQLGLFMAVMPTLIQA
GASASSSIVVEVLRILVLIGQILFSLAAVFLLCLVIKKYLIGPYYRKLHMESKGNKEILILGI
SAFIFLMLTVTELLDVSMELGCFLAGALVSSQGPVVTEEIATSIEPIRDFLAIVFFASIGLHV
FPTFVAYELTVLVFLTLSVVVMKFLLAALVLSLILPRSSQYIKWIVSAGLAQVSEFSFVLGSR
ARRAGVISREVYLLILSVTTLSLLLAPVLWRAAITRCVPRPERRSSL
```

Signal peptide:
amino acids 1-22

Transmembrane domains:
amino acids 282-304, 322-337, 354-370, 379-395, 445-474, 501-520, 576-598, 641-660

N-glycosylation sites.
amino acids 104-108, 174-178, 206-210, 230-234 cAMP- and cGMP-dependent protein kinase phosphorylation site.
amino acids 55-59, 673-677

Tyrosine kinase phosphorylation site.
amino acids 407-414

N-myristoylation sites.
amino acids 116-122, 327-333, 366-372, 401-407, 419-425, 429-435, 442-448, 525-531, 530-536

Cell attachment sequence.
amino acids 404-407

FIGURE 231

GAGAAAAACAACAGGAAGCAGCTTACAAACTCGGTGAACAACTGAGGGAACCAAACCAGAGAC
GCGCTGAACAGAGAGAATCAGGCTCAAAGCAAGTGGAAGTGGGCAGAGATTCCACCAGGACTG
GTGCAAGGCGCAGAGCCAGCCAGATTTGAGAAGAAGGCAAAAAG<u>ATG</u>CTGGGGAGCAGAGCTG
TAATGCTGCTGTTGCTGCTGCCCTGGACAGCTCAGGGCAGAGCTGTGCCTGGGGGCAGCAGCC
CTGCCTGGACTCAGTGCCAGCAGCTTTCACAGAAGCTCTGCACACTGGCCTGGAGTGCACATC
CACTAGTGGGACACATGGATCTAAGAGAAGAGGGAGATGAAGAGACTACAAATGATGTTCCCC
ATATCCAGTGTGGAGATGGCTGTGACCCCCAAGGACTCAGGGACAACAGTCAGTTCTGCTTGC
AAAGGATCCACCAGGGTCTGATTTTTATGAGAAGCTGCTAGGATCGGATATTTTCACAGGGG
AGCCTTCTCTGCTCCCTGATAGCCCTGTGGGCCAGCTTCATGCCTCCCTACTGGGCCTCAGCC
AACTCCTGCAGCCTGAGGGTCACCACTGGGAGACTCAGCAGATTCCAAGCCTCAGTCCCAGCC
AGCCATGGCAGCGTCTCCTTCTCCGCTTCAAAATCCTTCGCAGCCTCCAGGCCTTTGTGGCTG
TAGCCGCCCGGGTCTTTGCCCATGGAGCAGCAACCCTGAGTCCC<u>TAA</u>AGGCAGCAGCTCAAGG
ATGGCACTCAGATCTCCATGGCCCAGCAAGGCCAAGATAAATCTACCACCCCAGGCACCTGTG
AGCCAACAGGTTAATTAGTCCATTAATTTTAGTGGGACCTGCATATGTTGAAAATTACCAATA
CTGACTGACATGTGATGCTGACCTATGATAAGGTTGAGTATTTATTAGATGGGAAGGGAAATT
TGGGGATTATTTATCCTCCTGGGGACAGTTTGGGGAGGATTATTTATTGTATTTATATTGAAT
TATGTACTTTTTTCAATAAAGTCTTATTTTTGTGGCTAAAAAAAAAAAAA

FIGURE 232

MLGSRAVMLLLLLPWTAQGRAVPGGSSPAWTQCQQLSQKLCTLAWSAHPLVGHMDLREEGDEE
TTNDVPHIQCGDGCDPQGLRDNSQFCLQRIHQGLIFYEKLLGSDIFTGEPSLLPDSPVGQLHA
SLLGLSQLLQPEGHHWETQQIPSLSPSQPWQRLLLRFKILRSLQAFVAVAARVFAHGAATLSP

Important features of the protein:
Signal peptide:
amino acids 1-21

Casein kinase II phosphorylation site.
amino acids 64-67

N-myristoylation sites.
amino acids 25-30, 81-86, 122-127

FIGURE 233

```
CCCACGCGTCCGGCCCTGTAACCAAGATACTGACTGAACATGGCTGGCGGACTCAGGCTGGGGTCTGCAGTGCAG
CATTAATGGGCCGCTGACATGAATATGGAGTAGTTTTCTCTAGCAAAGAGTAATGTGGGCCATGGAGTCAGGCCA
CCTCCTCTGGGCTCTGCTGTTCATGCAGTCCTTGTGGCCTCAACTGACTGATGGAGCCACTCGAGTCTACTACCT
GGGCATCCGGGATGTGCAGTGGAACTATGCTCCCAAGGGAAGAAATGTCATCACGAACCAGCCTCTGGACAGTGA
CATAGTGGCTTCCAGCTTCTTAAAGTCTGACAAGAACCGGATAGGGGGAACCTACAAGAAGACCATCTATAAAGA
ATACAAGGATGACTCATACACAGATGAAGTGGCCCAGCCTGCCTGGTTGGGCTTCCTGGGGCAGTGTTGCAGGC
TGAAGTGGGGGATGTCATTCTTATTCACCTGAAGAATTTTGCCACTCGTCCCTATACCATCCACCCTCATGGTGT
CTTCTACGAGAAGGACTCTGAAGGTTCCCTATACCCAGATGGCTCCTCTGGGCCACTGAAAGCTGATGACTCTGT
TCCCCCGGGGGCAGCCATATCTACAACTGGACCATTCCAGAAGGCCATGCACCCACCGATGCTGACCCAGCGTG
CCTCACCTGGATCTACCATTCTCATGTAGATGCTCCACGAGACATTGCAACTGGCCTAATTGGGCCTCTCATCAC
CTGTAAAGAGGAGCCCTGGATGGGAACTCCCCTCCTCAACGCCAGGATGTAGACCATGATTTCTTCCTCCTCTT
CAGTGTGGTAGATGAGAACCTCAGCTGGCATCTCAATGAGAACATTGCCACTTACTGCTCAGATCCTGCTTCAGT
GGACAAAGAAGATGAGACATTTCAGGAGAGCAATAGGATGCATGCAATCAATGGCTTTGTTTTTGGGAATTTACC
TGAGCTGAACATGTGTGCACAGAAACGTGTGGCCTGGCACTTGTTTGGCATGGGCAATGAAATTGATGTCCACAC
AGCATTTTTCCATGGACAGATGCTGACTACCCGTGGACACCACACTGATGTGGCTAACATCTTTCCAGCCACCTT
TGTGACTGCTGAGATGGTGCCCTGGGAACCTGGTACCTGGTTAATTAGCTGCCAAGTGAACAGTCACTTTCGAGA
TGGCATGCAGGCACTCTACAAGGTCAAGTCTTGCTCCATGGCCCCTCCTGTGGACCTGCTCACAGGCAAAGTTCG
ACAGTACTTCATTGAGGCCCATGAGATTCAATGGGACTATGGCCCGATGGGGCATGATGGGAGTACTGGGAAGAA
TTTGAGAGAGCCAGGCAGTATCTCAGATAAGTTTTTCCAGAAGAGCTCCAGCCGAATTGGGGGCACTTACTGGAA
AGTGCGATATGAAGCCTTTCAAGATGAGACATTCCAAGAGAAGATGCATTTGGAGGAAGATAGGCATCTTGGAAT
CCTGGGGCCAGTGATCCGGGCTGAGGTGGGTGACACCATTCAGGTGGTCTTCTACAACCGTGCCTCCCAGCCATT
CAGCATGCAGCCCCATGGGGTCTTTTATGAGAAAGACTATGAAGGCACTGTGTACAATGATGGCTCATCTTACCC
TGGCTTGGTTGCCAAGCCCTTTGAGAAAGTAACATACCGCTGGACAGTCCCCCCTCATGCCGGTCCCACTGCTCA
GGATCCTGCTTGTCTCACTTGGATGTACTTCTCTGCTGCAGATCCCATAAGAGACACAAATTCTGGCCTGGTGGG
CCCGCTGCTGGTGTGCAGGGCTGGTGCCTTGGGTGCAGATGGCAAGCAGAAAGGGGTGGATAAAGAATTCTTTCT
TCTCTTCACTGTGTTGGATGGAGACAAGAGCTGGTACAGCAATGCCAATCAAGCAGCTGCTATGTTGGATTTCCG
ACTGCTTTCAGAGGATATTGAGGGCTTCCAAGACTCCAATCGGATGCATGCCATTAATGGGTTTCTGTTCTCTAA
CCTGCCCAGGCTGGACATGTGCAAGGGTGACACAGTGGCCTGGCACCTGCTCGGCCTGGGCACAGAGACTGATGT
GCATGGAGTCATGTTCCAGGGCAACACTGTGCAGCTTCAGGGCATGAGGAAGGGTGCAGCTATGCTCTTTCCTCA
TACCTTTGTCATGGCCATCATGCAGCCTGACAACCTTGGGACATTTGAGATTTATTGCCAGGCAGGCAGCCATCG
AGAAGCAGGGATGAGGGCAATCTATAATGTCTCCCAGTGTCCTGGCCACCAAGCCACCCCTCGCCAACGCTACCA
AGCTGCAAGAATCTACTATATCATGGCAGAAGAAGTAGAGTGGGACTATTGCCCTGACCGGAGCTGGGAACGGGA
ATGGCACAACCAGTCTGAGAAGGACAGTTATGGTTACATTTTCCTGAGCAACAAGGATGGGCTCCTGGGTTCCAG
ATACAAGAAAGCTGTATTCAGGGAATACACTGATGGTACATTCAGGATCCCTCGGCCAAGGACTGGACCAGAAGA
ACACTTGGGAATCTTGGGTCCACTTATCAAAGGTGAAGTTGGTGATATCCTGACTGTGGTATTCAAGAATAATGC
CAGCCGCCCCTACTCTGTGCATGCTCATGGAGTGCTAGAATCTACTACTGTCTGGCCCACTGGCTGCTGAGCCTGG
TGAGGTGGTCACTTATCAGTGGAACATCCCAGAGAGGTCTGGCCCTGGGCCAATGACTCTGCTTGTGTTTCCTG
GATCTATTATTCTGCAGTGGATCCCATCAAGGACATGTATAGTGGCCTGGTGGGGCCCTTGGCTATCTGCCAAAA
GGGCATCCTGGAGCCCCATGGAGGACGGAGTGACATGGATCGGAATTTGCATTGTTGTTCTTGATTTTTGATGA
AAATAAGTCTTGGTATTTGGAGGAAAATGTGGCAACCCATGGGTCCCAGGATCCAGGCAGTATTAACCTACAGGA
TGAAACTTTCTTGGAGAGCAATAAAATGCATGCAATCAATGGGAAACTCTATGCCAACCTTAGGGGTCTTACCAT
GTACCAAGGAGAACGAGTGGCCTGGTACATGCTGGCCATGGGCCAAGATGTGGATCTACACACCATCCACTTTCA
TGCAGAGAGCTTCCTCTATCGGAATGGCGAGAACTACCGGGCAGATGTGGTGGATCTGTTCCCAGGGACTTTTGA
GGTTGTGGAGATGGTGGCCAGCAACCCTGGGACATGGCTGATGCACTGCCATGTGACTGACCATGTCCATGCTGG
CATGGAGACCCTCTTCACTGTTTTTTCTCGAACAGAACACTTAAGCCCTCTCACCGTCATCACCAAAGAGACTGA
AAAAGTGCCCCCAGAGACATTGAAGAGGCAATGTGAAGATGCTGGGCATGCAGATCCCCATAAAGAATGTTGA
GATGCTGGCCTCTGTTTTGGTTGCCATTAGTGTCACCCTTCTGCTCGTTGTTCTGGCTCTTGGTGGAGTGGTTTG
GTACCAACATCGACAGAGAAAGCTACGACGCAATAGGAGGTCCATCCTGGATGACAGCTTCAAGCTTCTGTCTTT
CAAACAGTAACATCTGGAGCCTGGAGATATCCTCAGGAAGCACATCTGTAGTGCACTCCCAGCAGGCCATGGACT
AGTCACTAACCCCACACTCAAAGGGGCATGGGTGGTGGAGAAGCAGAAGGAGCAATCAAGCTTATCTGGATATTT
CTTTCTTTATTTATTTTACATGGAAATAATATGATTTCACTTTTTCTTTAGTTTCTTTGCTCTACGTGGGCACCT
GGCACTAAGGGAGTACCTTATTATCCTACATCGCAAATTTCAACAGCTACATTATATTTCCTTCTGACACTTGGA
AGGTATTGAAATTTCTAGAAATGTATCCTTCTCACAAAGTAGAGACCAAGAGAAAAACTCATTGATTGGGTTTCT
ACTTCTTTCAAGGACTCAGGAAATTTCACTTTGAACTGAGGCCAAGTGAGCTGTTAAGATAACCCACACTTAAAC
TAAAGGCTAAGAATATAGGCTTGATGGGAAATTGAAGGTAGGCTGAGTATTGGGAATCCAAATTGAATTTTGATT
CTCCTTGGCAGTGAACTACTTTGAAGAAGTGGTCAATGGGTTGTTGCTGCCATGAGCATGTACAACCTCTGGAGC
TAGAAGCTCCTCAGGAAAGCCAGTTCTCCAAGTTCTTAACCTGTGGCACTGAAAGGAATGTTGAGTTACCTCTTC
ATGTTTTAGACAGCAAACCCTATCCATTAAAGTACTTGTTAGACCAAAAAAAAAAAAA
```

FIGURE 234

```
MWAMESGHLLWALLFMQSLWPQLTDGATRVYYLGIRDVQWNYAPKGRNVITNQPLDSDIVASS
FLKSDKNRIGGTYKKTIYKEYKDDSYTDEVAQPAWLGFLGPVLQAEVGDVILIHLKNFATRPY
TIHPHGVFYEKDSEGSLYPDGSSGPLKADDSVPPGGSHIYNWTIPEGHAPTDADPACLTWIYH
SHVDAPRDIATGLIGPLITCKRGALDGNSPPQRQDVDHDFFLLFSVVDENLSWHLNENIATYC
SDPASVDKEDETFQESNRMHAINGFVFGNLPELNMCAQKRVAWHLFGMGNEIDVHTAFFHGQM
LTTRGHHTDVANIFPATFVTAEMVPWEPGTWLISCQVNSHFRDGMQALYKVKSCSMAPPVDLL
TGKVRQYFIEAHEIQWDYGPMGHDGSTGKNLREPGSISDKFFQKSSSRIGGTYWKVRYEAFQD
ETFQEKMHLEEDRHLGILGPVIRAEVGDTIQVVFYNRASQPFSMQPHGVFYEKDYEGTVYNDG
SSYPGLVAKPFEKVTYRWTVPPHAGPTAQDPACLTWMYFSAADPIRDTNSGLVGPLLVCRAGA
LGADGKQKGVDKEFFLLFTVLDENKSWYSNANQAAAMLDFRLLSEDIEGFQDSNRMHAINGFL
FSNLPRLDMCKGDTVAWHLLGLGTETDVHGVMFQGNTVQLQGMRKGAAMLFPHTFVMAIMQPD
NLGTFEIYCQAGSHREAGMRAIYNVSQCPGHQATPRQRYQAARIYYIMAEEVEWDYCPDRSWE
REWHNQSEKDSYGYIFLSNKDGLLGSRYKKAVFREYTDGTFRIPRPRTGPEEHLGILGPLIKG
EVGDILTVVFKNNASRPYSVHAHGVLESTTVWPLAAEPGEVVTYQWNIPERSGPGPNDSACVS
WIYYSAVDPIKDMYSGLVGPLAICQKGILEPHGGRSDMDREFALLFLIFDENKSWYLEENVAT
HGSQDPGSINLQDETFLESNKMHAINGKLYANLRGLTMYQGERVAWYMLAMGQDVDLHTIHFH
AESFLYRNGENYRADVVDLFPGTFEVVEMVASNPGTWLMHCHVTDHVHAGMETLFTVFSRTEH
LSPLTVITKETEKVPPRDIEEGNVKMLGMQIPIKNVEMLASVLVAISVTLLLVVLALGGVVWY
QHRQRKLRRNRRSILDDSFKLLSFKQ
```

Signal peptide:

amino acids 1-21

Transmembrane domain:

amino acids 1109-1130

N-glycosylation sites.

amino acids 167-171, 239-243, 591-595, 717-721, 761-765, 832-836, 876-880, 934-938

Glycosaminoglycan attachment site.

amino acids 871-875

Tyrosine kinase phosphorylation sites.

amino acids 82-90, 137-145, 494-502, 513-521

N-myristoylation sites.

amino acids 212-218, 313-319, 498-504, 566-572, 672-678, 778-784, 843-849

Multicopper oxidases signature 1.

amino acids 344-365, 696-717, 1043-1064

Multicopper oxidases signature 2.

amino acids 1048-1060

FIGURE 235

```
GGAAAGAGTGCTGGTACTACAACCAGGAAGTGACAGATAATGTGCTTTAAACTACATTAGAAAAGCTTCTCATAG
CAAAACTGAGAGATTGAAGCAGTGATTATTTTTACATAGTTGTCATTAAATATTTGGAGCTCTGCTGTGCATAGA
GATGGCAACATACTTAGAATACACAGCTTTCTGGGCCAGAAATTGATCTTCTGACTTTTGAGCCTTATCTGATTA
CTGCTTGGTTCATCTTTATTTTGTTAAACTACTCTGTAGGCTGAAAGGGAGAGACTCTCCTTGGTTTGCAGAGCC
TGACTAGACAGGAATTCTGGCAACTGCTCCAGCAGAACTATGGCACTGAGCTAGGTTTAAATGCTGAGGAGATGG
AAAACTTGTCACTGTCGATTGAGGATGTGCAGCCAAGAAGTCCAGGAAGAAGCAGCTTGGATGACTCTGGGGAGA
GAGATGAAAAATTATCCAAGTCAATCAGTTTTACCAGTGAATCAATTAGTCGGGTTTCAGAAACAGAGTCATTCG
ATGGAAATTCATCAAAAGGAGGATTAGGCAAAGAGGAGTCCCAAAATGAGAAACAGACCAAAAGAGTCTCTTAC
CAACTTTGGAAAAGAAGTTAACTAGAGTGCCATCAAAGTCACTGGACTTGAATAAAAATGAATATCTTTCTCTGG
ACAAAAGCAGCACTTCAGATTCTGTTGATGAAGAAAATGTTCCTGAGAAAGATCTTCATGGAAGACTTTTTATCA
ACCGTATTTTTCATATCAGTGCTGACAGAATGTTTGAATTGCTCTTTACCAGTTCACGCTTTATGCAGAAATTTG
CCAGTTCTAGAAATATAATAGATGTAGTATCTACCCCTTGGACTGCAGAACTTGGAGGTGATCAGCTGAGAACGA
TGACCTACACTATAGTCCTTAATAGTCCACTTACTGGAAAATGCACTGCTGCCACTGAAAAGCAGACACTGTATA
AGAAAGTCGGGAAGCACGATTTATTTGGTAGATTCAGAAGTACTGACACATGATGTCCCCTACCATGATTACT
TCTATACCGTGAACAGATACTGTATCATCCGATCTTCAAACAGAAATGCAGGCTAAGAGTTTCCACAGATTTGA
AATACAGAAAACAGCCATGGGGCCTTGTCAAATCTTTAATTGAAAAGAATTCCTGGAGTTCTTTGGAGGACTATT
TCAAACAGCTTGAATCAGATTTGTTAATTGAAGAATCTGTATTAAATCAGGCCATTGAAGACCCTGGAAAACTTA
CTGGCCTACGAAGGAGAAGGCGAACCTTCAACCGAACAGCAGAAACAGTTCCTAAACTTTCCTCTCAGCATTCCT
CTGGAGATGTGGGCTTAGGTGCCAAAGGGGATATTACAGGAAGAAAAAGGAAATGGAAAACTATAACGTCACTC
TTATTGTGGTAATGAGTATTTTTGTGTTGTTATTAGTTTTGTTGAATGTGACACTGTTTCTGAAGCTGTCAAAGA
TAGAACATGCTGCTCAGTCCTTTTACCGTCTCCGCCTCCAAGAAGAGAAATCTTTAAATTTAGCCTCTGATATGG
TGTCAAGAGCAGAAACTATTCAGAAGAATAAAGATCAGGCCCATCGTTTAAAGGGAGTGCTCCGAGACTCCATAG
TGATGCTTGAACAGCTGAAGAGCTCACTCATTATGCTTCAGAAAACGTTTGATCTACTAAATAAGAATAAGACTG
GCATGGCTGTTGAAAGCTAGTGATCTGAAGGACTAAAACCGCAGAGATACTTGGAACTTAAAGAAAATACCTGGA
AGAAAACCAGACGAATGAAGGATTTTGGCATAGAACATTTCTATGTTTTTCATTATTGAGATTTCTAATATGAA
CATTTCTTTCAGTAACATTTATTTGATAATTAGTTTCTGCTGGCCTTAATAATCCATCCTTTCACTTCTTATAGA
TATTTTTAAGCTGTGAATTTCTTCAGTGAACCATGAAATATATTATAGAACTGAATTTCTCTGATACAAAAAGAA
AATGACACACCCTGAATTGAGTGGTATGGTCTCATTTCTACAGTGAAGTCTGATGCTTTGTTAGCACAGAATCCG
TACATGTCCAATAGGTCGCTTTTGTAACTGAGATAAGACCAAGAGGATAAACAGGACAATATAAGAAGAAACCTC
TATGTCATTACTGATTTTAAAGGTTCTGTTTTCAGGCATATAACATTTCCAGGTTTGTGTACTGTAAAGATTATA
ATGTCTTCATTTATTTAGCATGCAAATTTAATAGTCAAACTTTTTGAATCTGCATGTTGATGATGATTATCAGAA
AGGGTCTTCTGCCATGCTGTATCTTTATGAAAGAAATAGTTGTTTTTCTTAAGGTAACTATCAGAGGTGGGATT
ATCTTGCCTCCTCACTTAGAATACCAACAGTCAAAAGGAAGAACCATCCTCTGAGTTTTAAAAACCAGAAGGTTA
TGTTAAAATCTGGGCATTTAGTGACAGATCAAATGCATACTTGAACTAAGATTGGCTTCAGCTTAGCAGTCTTTC
ATGGTGGAAGTGACACATCTGGTTGAAAATAAATTTGTGTATTTTCAGTAACCATGTATGGCTTCCTTCTTTATGT
ATGTGTGTGACTTGTTTTAATTGGTAAGTTATAAGCCAGACATAGATTTTAGCTCTTTAATAAAAACTTCAGGGG
CACGTATGTCCCAGTACAAGTGTACTGACTATCAAGTTTTAACTCAGATGCAAGCTTTGGCTCTTTCATAAAAAG
TTTTTATGCATATGTGTCTCCATACAAGTGGCTCATTAAAATAAGAACTTTGTAAACTGACTTAAAATCAGATAT
TTTTTCAAGAGTTAGGGAAAGTTGAAGTGTTTTACTGTTTTGTCTCTTGAGCCCTTTCTCTGGGAAAAAATACA
TATCCATCTATCTATCTATATATAAACTGTGTATACATTCTTACTGTTTGAACAACTATTGCCTTTAATTAAATG
TTTCATTTTTCTCCAGAGTCCCCAAAGCCACATGGCATTATTATAGTCATTTTGAGATGCCTGTAGAGAATGAA
AGTATTGACTCCGTTAGAGGGAAAATGGGTTTCTCTGGGTGAATTCCAACGAAGCATACCTAGGGGTAACAGTGA
ACCTACCTGGGTTTGTTTTGTTTTGGTAAGGATTTATGTAGTGTCTGGCTGTAAGCAAGAATGAGTGGATTATAA
ACTTGAAGATTTCTCTGTTAAAGTCACAAAAATGATCGACAAACAATATTTTTGTGATGTTTATTTAAACGTTGT
ATTTTATAACATACTTCAAGGAAGAGTATCGAAGTAAGTTGCTTTATAAATTAAGACTAAATTCGTATGGATGCA
GAATTCAATTAATAAAATTTGAGCCTGTTACGTAAATTGAATATTAATAAAATTGAAAATTTCAAAA
```

FIGURE 236

MENLSLSIEDVQPRSPGRSSLDDSGERDEKLSKSISFTSESISRVSETESFDGNSSKGGLGKE
ESQNEKQTKKSLLPTLEKKLTRVPSKSLDLNKNEYLSLDKSSTSDSVDEENVPEKDLHGRLFI
NRIFHISADRMFELLFTSSRFMQKFASSRNIIDVVSTPWTAELGGDQLRTMTYTIVLNSPLTG
KCTAATEKQTLYKESREARFYLVDSEVLTHDVPYHDYFYTVNRYCIIRSSKQKCRLRVSTDLK
YRKQPWGLVKSLIEKNSWSSLEDYFKQLESDLLIEESVLNQAIEDPGKLTGLRRRRRTFNRTA
ETVPKLSSQHSSGDVGLGAKGDITGKKKEMENYNVTLIVVMSIFVLLLVLLNVTLFLKLSKIE
HAAQSFYRLRLQEEKSLNLASDMVSRAETIQKNKDQAHRLKGVLRDSIVMLEQLKSSLIMLQK
TFDLLNKNKTGMAVES

Transmembrane domain:
amino acids 352-371

N-glycosylation sites.
amino acids 3-7, 54-58, 312-316, 349-353, 367-371, 449-453 cAMP- and cGMP-dependent protein kinase phosphorylation sites.
amino acids 81-85, 307-311

Tyrosine kinase phosphorylation sites.
amino acids 202-211, 246-254, 341-349

N-myristoylation site.
amino acids 259-265

Amidation site.
amino acids 339-343

FIGURE 237

CAGGGGCTGGAGGGCAGGGGAGGGG<u>ATG</u>ATGTCATTCCTGCTCGGCGCAATCCTGACCCTGCT
CTGGGCGCCCACGGCTCAGGCTGAGGTTCTGCTGCAGCCTGACTTCAATGCTGAAAAGTTCTC
AGGCCTCTGGTACGTGGTCTCCATGGCATCTGACTGCAGGGTCTTCCTGGGCAAGAAGGACCA
CCTGTCCATGTCCACCAGGGCCATCAGGCCCACAGAGGAGGGCGGCCTCCACGTCCACATGGA
GTTCCCGGGGCGGACGGCTGTAACCAGGTGGATGCCGAGTACCTGAAGGTGGGCTCCGAGGG
ACACTTCAGAGTCCCGGCCTTGGGCTACCTGGACGTGCGCATCGTGGACACAGACTACAGCTC
CTTCGCCGTCCTTTACATCTACAAGGAGCTGGAGGGGCCCTCAGCACCATGGTGCAGCTCTA
CAGCCGGACCCAGGATGTGAGTCCCCAGGCTCTGAAGTCCTTCCAGGACTTCTACCCGACCCT
GGGGCTCCCCAAGGACATGATGGTCATGCTGCCCCAGTCAGATGCATGCAACCCTGAGAGCAA
GGAGGCGCCC<u>TGA</u>CACCTCCGGAGCCCCACCCCGCCCTTCCCAGGTGGAGCCAAAGCAGCAG
GCGCCTTTGCCCCTGGAGTCAAGACCCACAGCCCTCGGGGACCACCTGGAGTCTCTCCATCCT
CCACCCCCGCCTGTGGGATGCCTTGTGGGACGTCTCTTTCTATTCAATAAACAGATGCTGCA
GCCTCA

FIGURE 238

MMSFLLGAILTLLWAPTAQAEVLLQPDFNAEKFSGLWYVVSMASDCRVFLGKKDHLSMSTRAI
RPTEEGGLHVHMEFPGADGCNQVDAEYLKVGSEGHFRVPALGYLDVRIVDTDYSSFAVLYIYK
ELEGALSTMVQLYSRTQDVSPQALKSFQDFYPTLGLPKDMMVMLPQSDACNPESKEAP

Signal peptide:

amino acids 1-20

Tyrosine kinase phosphorylation site.

amino acids 110-117

N-myristoylation sites.

amino acids 7-13, 79-85, 130-136

Amidation site.

amino acids 50-54

FIGURE 239

```
GGCGCGCTGGTCCAGGTGAGCGGGCGCGTCCCCGCGACGGCGCTGCCTGCCCGAGGCGGTTCA
CGTAAAGACAGCGAGATCCTGAGGGCCAGCCGGGAAGGAGGCGTGGATATGGAGCTGGCTGCT
GCCAAGTCCGGGCCCGCGCCGCTGCCTAGCGCGTCCTGGGGACTCTGTGGGGACGCGCCCCG
CGCCGCGGCTCGGGGACCCGTAGAGCCCGGCGCTGCGCGCATGGCCCTGCTCTCGCGCCCCGC
GCTCACCCTCCTGCTCCTCCTCATGGCCGCTGTTGTCAGGTGCCAGGAGCAGGCCCAGACCAC
CGACTGGAGAGCCACCCTGAAGACCATCCGGAACGGCGTTCATAAGATAGACGTACCTGAA
CGCCGCCTTGGACCTCCTGGGAGGCGAGGACGGTCTCTGCCAGTATAAATGCAGTGACGGATC
TAAGCCTTTCCCACGTTATGGTTATAAACCCTCCCCACCGAATGGATGTGGCTCTCCACTGTT
TGGTGTTCATCTTAACATTGGTATCCCTTCCCTGACAAAGTGTTGCAACCAACACGACAGGTG
CTATGAGACCTGTGGCAAAAGCAAGAATGACTGTGATGAAGAATTCCAGTATTGCCTCTCCAA
GATCTGCCGAGATGTACAGAAAACACTAGGACTAACTCAGCATGTTCAGGCATGTGAAACAAC
AGTGGAGCTCTTGTTTGACAGTGTTATACATTTAGGTTGTAAACCATATCTGGACAGCCAACG
AGCCGCATGCAGGTGTCATTATGAAGAAAAAACTGATCTTTAAAGGAGATGCCGACAGCTAGT
GACAGATGAAGATGGAAGAACATAACCTTTGACAAATAACTAATGTTTTACAACATAAAACT
GTCTTATTTTTGTGAAAGGATTATTTTGAGACCTTAAAATAATTTATATCTTGATGTTAAAAC
CTCAAAGCAAAAAAAGTGAGGGAGATAGTGAGGGGAGGGCACGCTTGTCTTCTCAGGTATCTT
CCCCAGCATTGCTCCCTTACTTAGTATGCCAAATGTCTTGACCAATATCAAAAACAAGTGCTT
GTTTAGCGGAGAATTTTGAAAAGAGGAATATATAACTCAATTTTCACAACCACATTTACCAAA
AAAAGAGATCAAATATAAAATTCATCATAATGTCTGTTCAACATTATCTTATTTGGAAAATGG
GGAAATTATCACTTACAAGTATTTGTTTACTATGAAATTTTAAATACACATTTATGCCTAGAA
GGAACGGACTTTTTTTTTCTATTTTAATTACACATAATATGTAATTAAAGTACAACATAATAT
GTTGTTTCTCTGTAGCCCGTTGAGCATATGAGTAAGTCACATTTCTATTAGGACTACTTACAA
GGACAAGGTTTCCATTTTTCCAGTTGTAAAATTGGAACCATCAGCTGATAACCTCGTAGGGAG
CAACCCCAGGATAGCTAAGTGTTATGTAATATGCCTAGAAGGTGATGTGAATGCGATTCAGAA
GCATAGCCACTCCCATTTTATGAGCTACTCACATGACAAATGTCATCTTTTGCTATAACCTTT
GCCAAGTTAGAGAAAGATGGATTTAATGAGATAAATGAAAGATATTTAACCTAAAAAAAAA
AAAAAAAAAAAAAAAAA
```

FIGURE 240

MALLSRPALTLLLLLMAAVVRCQEQAQTTDWRATLKTIRNGVHKIDTYLNAALDLLGGEDGLC
QYKCSDGSKPFPRYGYKPSPPNGCGSPLFGVHLNIGIPSLTKCCNQHDRCYETCGKSKNDCDE
EFQYCLSKICRDVQKTLGLTQHVQACETTVELLFDSVIHLGCKPYLDSQRAACRCHYEEKTDL

Important features:
Signal peptide:
amino acids 1-22

N-myristoylation sites:
amino acids 57-63,93-99

Phospholipase A2 histidine active site:
amino acids 106-114

Neuraxin and MAP1B proteins repeat proteins Block:
amino acids 109-137

FIGURE 241

GATTCCGAGCGCCTCCACTGCTGGTCCGTTGGCCAGATCAACTCGCCGCGTGGGCCGGCCGTT
CCCTGAGAGTCTGAGCGCTCGCCGCACCCCCTTCCGAGCTTCTATTGGCCGTAGCAGACGTCC
GTCTGCCGCTATCTCCGCCCCAATACGGAAGCGGCCTAGTCCTCCGGCTCCGACAGCTGGGTG
TCCAGGCCATGGGGCAGCCCTGGGCGGCTGGGAGCACGGACGGGGCGCCCGCGCAGCTGCCTC
TCGTGCTCACCGCGCTGTGGCCGCGGCCGTGGGCCTGGAGCTGGCTTACGTGCTGGTGCTCG
GTCCCGGGCCGCCGCCGCTGGGACCCCTGGCCCGGGCCTTGCAGCTGGCGCTGGCCGCCTTCC
AGCTGCTCAACCTGCTGGGCAACGTGGGGCTCTTCCTGCGCTCGGATCCCAGCATCCGTGGCG
TGATGCTGGCCGGCCGCGGTCTGGGCCAGGGCTGGGCTTACTGCTACCAATGCCAAAGCCAGG
TGCCGCCACGCAGCGGACACTGCTCTGCCTGCCGCGTCTGCATCCTGCGTCGGGACCACCACT
GCCGCCTGCTGGGCCGCTGCGTGGGCTTCGGCAACTACCGGCCCTTCCTGTGCCTGCTGCTTC
ATGCCGCCGGCGTCCTGCTCCACGTCTCTGTGCTGCTGGGCCCTGCACTGTCGGCCCTGCTGC
GAGCCCACACGCCCCTCCACATGGCTGCCCTCCTCCTGCTTCCCTGGCTCATGTTGCTCACAG
GCAGAGTGTCTCTGGCACAGTTTGCCTTGGCCTTCGTGACGGACACGTGCGTGGCGGGTGCGC
TGCTGTGCGGGGCTGGGCTGCTCTTCCATGGGATGCTGCTGCTGCGGGGCCAGACCACATGGG
AGTGGGCTCGGGGCCAGCACTCCTATGACCTGGGTCCCTGCCACAACCTGCAGGCAGCCCTGG
GGCCCCGCTGGGCCCTCGTCTGGCTCTGGCCCTTCCTGGCCTCCCCATTGCCTGGGGATGGGA
TCACCTTCCAGACCACAGCAGATGTGGGACACACAGCCTCCTGACTCCAGGAAGAGCCAGAGC
TGTGCAGGGAGGAAGGGGTGAGAGGGGGGCCCCACACCTAGACTCAGTAAGGAAGTCGGGTT
GGACCTTAACATCTGCATTGGACAACTCCACCCCTTCCTTGGCCTTGCCCCTGCCCGCCTACA
CTCCTACGTGTCCAGGGCTTGGGCCGTGACTTAGGCAGAGGAGTGCAGAGGAGGGTCTGGCAG
GGGCTGCTCAGGCCGCCTAGCTGCCCCTTTGCCAGGTTAATAAAGCACTGACTTGTTAA

FIGURE 242

MGQPWAAGSTDGAPAQLPLVLTALWAAAVGLELAYVLVLGPGPPPLGPLARALQLALAAFQLL
NLLGNVGLFLRSDPSIRGVMLAGRGLGQGWAYCYQCQSQVPPRSGHCSACRVCILRRDHHCRL
LGRCVGFGNYRPFLCLLLHAAGVLLHVSVLLGPALSALLRAHTPLHMAALLLLPWLMLLTGRV
SLAQFALAFVTDTCVAGALLCGAGLLFHGMLLLRGQTTWEWARGQHSYDLGPCHNLQAALGPR
WALVWLWPFLASPLPGDGITFQTTADVGHTAS

Important features:
Signal peptide:
amino acids 1-30

Transmembrane domain:
amino acids 51-66,143-160,174-191,198-214

N-myristoylation sites:
amino acids 2-8,8-14,30-36,81-87,88-94,90-96,206-212

Leucine zipper pattern:
amino acids 143-165,150-172,157-179,164-186

FIGURE 243

CTTGTCTTTGTGTCGGTTGTGATTTTCCTAATCTCTGATTTTCCTTTTCTCTCGGACGCTCTC
CCTCTTCGGACCCATTTTCTCCCGTGCTTCATGCCCTGATAGCCTGGCCCCTTCCCGGCTTCC
TTCGCTACCGGGGACGCCTCTAGTTTTTCTGAATTTCTGGCTGGCTCCACCCTCCGCGTTCAT
CTTCCTCAAGAGTTCGCCCCTCTGGGGGCTCCTCTGTGTAATCGTCGCCTTCTCTGGGTATTT
CTGTGAACTCCGTCTCACACCATCCGCCATCTTCTCTGCCTTGGCCCCTTTTCTCTGTACAG
CCAGCTCTGTGTCCTTTTCTTCTCCCCCTCTAAAATCGACTCCTCTTCTCCCTGAGAGCCCCA
CCTTTGTGCCCCACTCCTCATTTTCCTACGCCTCCCTCTCTCTGCTGGTCCTCTCTCTCCCTG
CAAGGTTCCATTCCATCAATTTGTTTGTCTTTTGTAGGGGTGGCATCCCCTCTGACTACTGCT
CCATCCTTTTTTTTTTTTTTTTTTTTTTGCTTGAGGATTTCACTTCAATCTTTTCTGGT
TGCGTCTCCACTTGTACTCAGCTTGTTAGGTCCAGGTCCAGTTGTTCTGCATCTGAGGCTGGC
GTGTGCTGTCTTCTCTGATTGGCCTAATCTCCCTCACCCCCGTGAGATCTGTTGTCAGCCTTC
GTTTCTCTTTCCTGTGTCCCAGCTTTTCTGCGGGTCTTGGCACCTTTCTTGGCCACAGATTTC
TGGGTTACAGAGCATGTGTGTCTGAGGCATTGCAGGCAGAAAAGGGTGGCCGACGTGACCTCT
AGCTGGACTGCTGGGCAGGGAGCTGTCCTAGATAAAATTGGAAAGAAACAGTGACCCAGAGA
CAGGTGGACAAAGAATTCGGGGACTGATGGGAACTGAGCTTGGGATCCAGACTGAAACTGATT
CCAGACTGACCTCTAGCACCCAGGACCCAGACACAGGGCATGGGACCCCAGCATTTGAGACT
TGTGCAGCTGTTCTGCCTTCTAGGGGCCATCCCCACTCTGCCTCGGGCTGGAGCTCTTTTGTG
CTATGAAGCAACAGCCTCAAGATTCAGAGCTGTTGCTTTCCATAACTGGAAGTGGCTTCTGAT
GAGGAACATGGTGTGTAAGCTGCAAGAGGGCTGCGAGGAGACGCTAGTGTTCATTGAGACAGG
GACTGCAAGGGGAGTTGTGGGCTTTAAAGGCTGCAGCTCGTCTTCGTCTTACCCTGCGCAAAT
CTCCTACCTTGTTTCCCCACCCGGAGTGTCCATTGCCTCCTACAGTCGCGTCTGCCGGTCTTA
TCTCTGCAACAACCTCACCAATTTGGAGCCTTTTGTGAAACTCAAGGCCAGCACTCCTAAGTC
TATCACATCTGCGTCCTGTAGCTGCCCGACCTGTGTGGGCGAGCACATGAAGGATTGCCTCCC
AAATTTTGTCACCACTAATTCTTGCCCCTTGGCTGCTTCTACGTGTTACAGTTCCACCTTAAA
ATTTCAGGCAGGGTTTCTCAATACCACCTTCCTCCTCATGGGGTGTGCTCGTGAACATAACCA
GCTTTTAGCAGATTTTCATCATATTGGGAGCATCAAAGTGACTGAGGTCCTCAACATCTTAGA
GAAGTCTCAGATTGTTGGTGCAGCATCCTCCAGGCAAGATCCTGCTTGGGGTGTCGTCTTAGG
CCTCCTGTTTGCCTTCAGGGACTGACCATCTAGCTGCACCCGACAAGCACCCAGACTCTTTCA
CATAACAAATAAAATAGCAGAGTTCCCTTAAAAAAAAAAAAAAAAAAAAAAAAAAAAAAAAAA
AAAAAAAAAA

FIGURE 244

MGPQHLRLVQLFCLLGAIPTLPRAGALLCYEATASRFRAVAFHNWKWLLMRNMVCKLQEGCEE
TLVFIETGTARGVVGFKGCSSSSSYPAQISYLVSPPGVSIASYSRVCRSYLCNNLTNLEPFVK
LKASTPKSITSASCSCPTCVGEHMKDCLPNFVTTNSCPLAASTCYSSTLKFQAGFLNTTFLLM
GCAREHNQLLADFHHIGSIKVTEVLNILEKSQIVGAASSRQDPAWGVVLGLLFAFRD

Important features:

Signal peptide:
amino acids 1-20

N-glycosylation sites:
amino acids 117-121,183-187

N-myristoylation sites:
amino acids 16-22,25-31,60-66,71-77,81-87,100-106,224-230,
235-241,239-245

Prokaryotic membrane lipoprotein lipid attachment site:
amino acids 181-192

FIGURE 245

```
GTGGAGTTGGGTGGTGTCGGGAGCCTCTCCCTGAGGGGCACCGCGTCTTCAGGAGCTGGGCCTCCAGTGCGGCGC
GATGTCAGGCGCGGTGACAGCTCTGTGAGTCCGAGGCCGCGGCCGTGGCGCTGGGCGGCTGCGGGGCCTGACCGG
TCCGCTCATGGTGCCGCCACGACGCCATCGCGGGGCAGGAAGGCCAGGGGTGCTGAGTTCTTCACCTCCTTTTAG
ACTGAGATCTGCCAAGTTTTCCGGCATTGCTCTTGAGGATCTCAGAAGGGCTCTTAAGACAAGACTGCAAATGGT
GTGTGTATTTGTCATGAACCGAATGAATTCCCAGAACAGTGGTTTCACTCAGCGCAGGCGAATGGCTCTTGGGAT
TGTTATTCTTCTGCTTGTTGATGTGATATGGGTTGCTTCCTCTGAACTTACTTCGTATGTTTTTACCCAGTACAA
CAAACCATTCTTCAGCACCTTTGCAAAAACATCTATGTTTGTTTTGTACCTTTTGGGCTTTATTATTTGGAAGCC
ATGGAGACAACAGTGTACAAGAGGACTTCGCGGAAAGCATGCTGCTTTTTTTGCAGATGCTGAAGGTTACTTTGC
TGCTTGCACAACAGATACAACTATGAATAGTTCTTTGAGTGAACCTCTGTATGTGCCTGTGAAATTCCATGATCT
TCCAAGTGAAAAACCTGAGAGCACAAACATTGATACTGAAAAAACCCCCAAAAAGTCTCGTGTGAGGTTCAGTAA
TATCATGGAGATTCGACAGCTTCCGTCAAGTCATGCATTGGAAGCAAAGTTGTCTCGCATGTCATATCCTGTGAA
AGAACAAGAATCCATACTGAAAACTGTGGGGAAACTTACTGCAACTCAAGTAGCGAAAATTAGCTTTTTTTTTG
CTTTGTGTGGTTTTTGGCAAATTTGTCATATCAAGAAGCACTTTCAGACACACAAGTTGCTATAGTTAATATTTT
ATCTTCAACTTCCGGACTTTTTACCTTAATCCTTGCTGCAGTATTTCCAAGTAACAGTGGAGATAGATTTACCCT
TTCTAAACTATTAGCTGTAATTTTAAGCATTGGAGGCGTTGTACTGGTAAACCTGGCAGGGTCTGAAAAACCTGC
TGGAAGAGACACAGTAGGTTCCATTTGGTCTCTTGCTGGAGCCATGCTCTATGCTGTCTATATTGTTATGATTAA
GAGAAAAGTAGATAGAGAAGACAAGTTGGATATTCCAATGTTCTTTGGTTTTGTAGGTTTGTTTAATCTGCTGCT
CTTATGGCCAGGTTTCTTTTTACTTCATTATACTGGATTTGAGGACTTCGAGTTTCCCAATAAAGTAGTATTAAT
GTGCATTATCATTAATGGCCTTATTGGAACAGTACTCTCAGAGTTCCTGTGGTTGTGGGGCTGCTTTCTTACCTC
ATCATTGATAGGCACACTTGCACTAAGCCTTACAATACCTCTGTCCATAATAGCTGACATGTGTATGCAAAAGGT
GCAGTTTTCTTGGTTATTTTTTGCAGGAGCTATCCCTGTATTTTTTTCATTTTTATTGTAACTCTCCTATGCCA
TTATAATAATTGGGATCCTGTGATGGTGGGAATCAGAAGAATATTTGCTTTTATATGCAGAAAACATCGAATTCA
GAGAGTTCCAGAAGACAGCGAACAGTGTGAGAGTCTCATTTCTATGCACAGTGTTTCTCAGGAGGATGGAGCTAG
TTAGCTGTCTGTTGTCTGTAGCCCAGCTTGATAATGGAACTATACAGCGAAGAGACAATCTCTGGCAAGTTTTTG
TAGAAAAAATGTTTCAGTGCCTAGTCTGAAAAATAACAGTTTGAGTTCTTTGAAACTCTAAAATATATTTTCTC
ATACCTGTTTTCTTCATTTTCATAATGAAGCACTTTGCTATGTAGCTGTGTACATATCACTACAGTTATAGGAAG
TTTCAGTCTACAGTCCATCCAAAGGACCAACCTGCCTTACACATCTCAAGGAATTCAGCTGTTGAAATCATTTGA
ACTAATCAAGGAATAAATCCTAATGTTCTGGGACTTTATTTTCACATGTTAAATGCTGGAATATATTATGAAAAT
GTTTTCAAGAAATCACTTAAGTGTTCATAGACCAGTATTTCTGACAGGTAAAATGCTAAAATAAGCTACCTGTAA
TAAGTGTGGATTATATTTTGGGTTTTGTAGAATATTGCAAATTAACCACACAAAAAATGTTTAATTTATGCAAC
AAGCATGTTTGTGCAAATTTCATGGACTTTAAAAAGAATAAGTATTTGAGAAAATATCTGGTTCACTTACACTA
CATTTACTGTATTATTCTTTTATAGCATTAGGTGCCTTGTATTTTAAATCTGTGACAAACCATGGCAAATTTTTA
AAGGGGAAGTATTATTATAAAATGAAGAAATATGTATTTCTAAAGGCTATATTGCTGTAAACTTAATTGATAAAG
CTCTGTTTAATTTAGAGTTTTGAAGAAATAGTCTCCCTTCAATTAAGAAATTTTCATAATGGAATGATTTAAATT
GAAGTGACAAAGAGTATTATTAAAATACAATGTTTATAAAAAAA
```

FIGURE 246

MVPPRRHRGAGRPGVLSSSPPFRLRSAKFSGIALEDLRRALKTRLQMVCVFVMNRMNSQNSGF
TQRRRMALGIVILLLVDVIWVASSELTSYVFTQYNKPFFSTFAKTSMFVLYLLGFIIWKPWRQ
QCTRGLRGKHAAFFADAEGYFAACTTDTTMNSSLSEPLYVPVKFHDLPSEKPESTNIDTEKTP
KKSRVRFSNIMEIRQLPSSHALEAKLSRMSYPVKEQESILKTVGKLTATQVAKISFFFCFVWF
LANLSYQEALSDTQVAIVNILSSTSGLFTLILAAVFPSNSGDRFTLSKLLAVILSIGGVVLVN
LAGSEKPAGRDTVGSIWSLAGAMLYAVYIVMIKRKVDREDKLDIPMFFGFVGLFNLLLLWPGF
FLLHYTGFEDFEFPNKVVLMCIIINGLIGTVLSEFLWLWGCFLTSSLIGTLALSLTIPLSIIA
DMCMQKVQFSWLFFAGAIPVFFSFFIVTLLCHYNNWDPVMVGIRRIFAFICRKHRIQRVPEDS
EQCESLISMHSVSQEDGAS

Important features:
Transmembrane domain:
amino acids 69-87,105-118,237-256,266-285,300-316,332-346,
364-379,399-419,453-472

N-glycosylation sites:
amino acids 157-161,255-259

N-myristoylation sites:
amino acids 14-20,329-335,404-410,407-413,418-424

FIGURE 247

CGTCTGTAGAGATATCATGAACTTCAACTTAGCTTTGGTACTTTCTTCCCTGAAGACAGAGGG
CAGAACTCTGAGTTCCAGAACCATTTTCAACTGTATTGGGGACCAATCACTTGACTCTATTCT
TGTCTCTCTGACAGATGACGCTACACTCTCCTCTGAATAATGGACACCATTTCTAAAACTGAA
TCCTGCTACTAAAATAATTCAGATGATATATTTTTCCAATTCTACAATCTTGCTTTGTTTTAT
TTAGTTGTTTTCTCTCTCTTCCCAGTTTTCCAGAGACTGGAGCTAAACTGGGCTTTCAACA
TCATC<u>ATG</u>AAGTTTATCCTCCTCTGGGCCCTCTTGAATCTGACTGTTGCTTTGGCCTTTAATC
CAGATTACACAGTCAGCTCCACTCCCCCTTACTTGGTCTATTTGAAATCTGACTACTTGCCCT
GCGCTGGAGTCCTGATCCACCCGCTTTGGGTGATCACAGCTGCACACTGCAATTTACCAAAGC
TTCGGGTGATATTGGGGGTTACAATCCCAGCAGACTCTAATGAAAGCATCTGCAAGTGATTG
GCTATGAGAAGATGATTCATCATCCACACTTCTCAGTCACTTCTATTGATCATGACATCATGC
TAATCAAGCTGAAAACAGAGGCTGAACTCAATGACTATGTGAAATTAGCCAACCTGCCCTACC
AAACTATCTCTGAAAATACCATGTGCTCTGTCTCTACCTGGAGCTACAATGTGTGTGATATCT
ACAAAGAGCCCGATTCACTGCAAACTGTGAACATCTCTGTAATCTCCAAGCCTCAGTGTCGCG
ATGCCTATAAAACCTACAACATCACGGAAAATATGCTGTGTGTGGGCATTGTGCCAGGAAGGA
GGCAGCCCTGCAAGGAAGTTTCTGCTGCCCCGGCAATCTGCAATGGGATGCTTCAAGGAATCC
TGTCTTTTGCGGATGGATGTGTTTTGAGAGCCGATGTTGGCATCTATGCCAAAATTTTTTACT
ATATACCCTGGATTGAAAATGTAATCCAAAATAAC<u>TGA</u>GCTGTGGCAGTTGTGGACCATATGA
CACAGCTTGTCCCCATCGTTCACCTTTAGAATTAAATATAAATTAACTCCTC

FIGURE 248

MKFILLWALLNLTVALAFNPDYTVSSTPPYLVYLKSDYLPCAGVLIHPLWVITAAHCNLPKLR
VILGVTIPADSNEKHLQVIGYEKMIHHPHFSVTSIDHDIMLIKLKTEAELNDYVKLANLPYQT
ISENTMCSVSTWSYNVCDIYKEPDSLQTVNISVISKPQCRDAYKTYNITENMLCVGIVPGRRQ
PCKEVSAAPAICNGMLQGILSFADGCVLRADVGIYAKIFYYIPWIENVIQNN

Important features:

Signal peptide:

amino acids 1-17

N-glycosylation sites:

amino acids 11-15,156-160,173-177

Tyrosine kinase phosphorylation site:

amino acids 108-117

N-myristoylation sites:

amino acids 182-188,203-209

Amidation site:

amino acids 185-189

Serine proteases, trypsin family, histidine active site:

amino acids 52-58

FIGURE 249

GCGAGGCGGCCGCTGTCTTCTGCTGCGGCTTCCGCGACCACAAGTACTGCTGCGACGACCCGC
ACAGCTTCTTCCCCTACGAGCACAGCTACATGTGGTGGCTCAGCATTGGCGCTCTCATAGGCC
TGTCCGTAGCAGCAGTGGTTCTTCTCGCCTTCATTGTTACCGCCTGTGTGCTCTGCTACCTGT
TCATCAGCTCTAAGCCCCACACAAAGTTGGACCTGGGCTTGAGCTTACAGACAGCAGGCCCTG
AGGAGGTTTCTCCTGACTGCCAAGGTGTGAACACAGGCATGGCGGCAGAAGTGCCAAAAGTGA
GCCCTCTCCAGCAGAGTTACTCCTGCTTGAACCCGCAGCTGGAGAGCAATGAGGGGCAGGCTG
TGAACTCCAAACGCCTCCTCCATCATTGCTTCATGGCCACAGTGACCACCAGTGACATTCCAG
GCAGCCCTGAGGAAGCCTCTGTACCCAACCCTGACCTATGTGGACCAGTCCCATAAACATTCA
ATAAATGTCTCCATACCATCAA

FIGURE 250

MWWLSIGALIGLSVAAVVLLAFIVTACVLCYLFISSKPHTKLDLGLSLQTAGPEEVSPDCQGV
NTGMAAEVPKVSPLQQSYSCLNPQLESNEGQAVNSKRLLHHCFMATVTTSDIPGSPEEASVPN
PDLCGPVP

Important features:

Signal peptide:

Amino acids 1-26

N-myristoylation sites:

Amino acids 7-13,11-17,62-68,93-99

FIGURE 251

GTGGTTTGGATTGAGCCGGGCCCGGCCGGGCGCCGAGTCGGAGGGGGTGGCAGTGAGCGGCG
GCAGAGGCTACGGGGCTCGGTTTGGCTGACTGGGGAGTCGGCAGGCGGCAGGAACATGCGAG
GCCAGCGGAGCCTGCTGCTGGGCCCGGCCCGCCTCTGCCTCCGCCTCCTTCTGCTGCTGGGTT
ACAGGCGCCGCTGTCCACCTCTACTCCGGGGTCTAGTACAGCGCTGGCGCTACGGCAAGGTCT
GCCTGCGCTCCCTGCTCTACAACTCCTTTGGGGGCAGTGACACCGCTGTTGATGCTGCCTTTG
AGCCTGTCTACTGGCTGGTAGACAACGTGATCCGCTGGTTTGGAGTGGTGTTCGTGGTCCTGG
TGATCGTGCTGACAGGCTCCATTGTAGCTATCGCCTACCTGTGTGTCCTGCCTCTCATCCTCC
GAACCTACTCAGTGCCACGACTCTGCTGGCATTTCTTCTATAGCCACTGGAATCTGATCCTGA
TTGTCTTCCACTACTACCAGGCCATCACCACTCCGCCTGGGTACCCACCCCAGGGCAGGAATG
ATATCGCCACCGTCTCCATCTGTAAGAAGTGCATTTACCCCAAGCCAGCCCGAACACACCACT
GCAGCATCTGCAACAGGTGTGTGCTGAAGATGGATCACCACTGCCCCTGGCTAAACAATTGTG
TGGGCCACTATAACCATCGGTACTTCTTCTCTTTCTGCTTTTTCATGACTCTGGGCTGTGTCT
ACTGCAGCTATGGAAGTTGGGACCTTTTCCGGGAGGCTTATGCTGCCATTGAGACTTATCACC
AGACCCCACCACCCACCTTCTCCTTTCGAGAAAGGATGACTCACAAGAGTCTTGTCTACCTCT
GGTTCCTGTGCAGTTCTGTGGCACTTGCCCTGGGTGCCCTAACTGTATGGCATGCTGTTCTCA
TCAGTCGAGGTGAGACTAGCATCGAAAGGCACATCAACAAGAAGGAGAGACGTCGGCTACAGG
CCAAGGGCAGAGTATTTAGGAATCCTTACAACTACGGCTGCTTGGACAACTGGAAGGTATTCC
TGGGTGTGGATACAGGAAGGCACTGGCTTACTCGGGTGCTCTTACCTTCTAGTCACTTGCCCC
ATGGGAATGGAATGAGCTGGGAGCCCCCTCCCTGGGTGACTGCTCACTCAGCCTCTGTGATGG
CAGTGTGAGCTGGACTGTGTCAGCCACGACTCGAGCACTCATTCTGCTCCCTATGTTATTTCA
AGGGCCTCCAAGGGCAGCTTTTCTCAGAATCCTTGATCAAAAGAGCCAGTGGGCCTGCCTTA
GGGTACCATGCAGGACAATTCAAGGACCAGCCTTTTACCACTGCAGAAGAAAGACACAATGT
GGAGAAATCTTAGGACTGACATCCCTTTACTCAGGCAAACAGAAGTTCCAACCCCAGACTAGG
GGTCAGGCAGCTAGCTACCTACCTTGCCCAGTGCTGACCCGGACCTCCTCCAGGATACAGCAC
TGGAGTTGGCCACCACCTCTTCTACTTGCTGTCTGAAAAAACACCTGACTAGTACAGCTGAGA
TCTTGGCTTCTCAACAGGGCAAAGATACCAGGCCTGCTGCTGAGGTCACTGCCACTTCTCACA
TGCTGCTTAAGGGAGCACAAATAAGGTATTCGATTTTAAAAAAAAAAAAAAAAAAAAAAAA
AAAAAAAAAAAA

FIGURE 252

MRGQRSLLLGPARLCLRLLLLLGYRRRCPPLLRGLVQRWRYGKVCLRSLLYNSFGGSDTAVDA
AFEPVYWLVDNVIRWFGVVFVVLVIVLTGSIVAIAYLCVLPLILRTYSVPRLCWHFFYSHWNL
ILIVFHYYQAITTPPGYPPQGRNDIATVSICKKCIYPKPARTHHCSICNRCVLKMDHHCPWLN
NCVGHYNHRYFFSFCFFMTLGCVYCSYGSWDLFREAYAAIETYHQTPPPTFSFRERMTHKSLV
YLWFLCSSVALALGALTVWHAVLISRGETSIERHINKKERRRLQAKGRVFRNPYNYGCLDNWK
VFLGVDTGRHWLTRVLLPSSHLPHGNGMSWEPPPWVTAHSASVMAV

Important features:
Transmembrane domain:
amino acids 88-100,202-216,254-274

N-myristoylation sites:
amino acids 55-61,56-62,92-98,210-216,309-315,319-325,340-346

Prokaryotic membrane lipoprotein lipid attachment site:
amino acids 201-212

FIGURE 253

```
GATCAAGCGCCTTCCTTTCCCTTCCTCTCCCTACTTGGCCTTTGCCCTAAGCCAAGACCTGGCCATCAGCCTGGC
TGCAGGGGCCTGCAGAGCCAGCTGCACTTTTTCAGGTATGGGGGAGGGCCAGGCACCATGAAGCCAGTGTGGGTC
GCCACCCTTCTGTGGATGCTACTGCTGGTGCCCAGGCTGGGGCCGCCCGGAAGGGGTCCCCAGAAGAGGCCTCC
TTCTACTATGGAACCTTCCCTCTTGGCTTCTCCTGGGGCGTGGGCAGTTCTGCCTACCAGACGGAGGGCGCCTGG
GACCAGGACGGGAAAGGGCCTAGCATCTGGGACGTCTTCACACACAGTGGGAAGGGGAAAGTGCTTGGGAATGAG
ACGGCAGATGTAGCCTGTGACGGCTACTACAAGGTCCAGGAGGACATCATTCTGCTGAGGGAACTGCACGTCAAC
CACTACCGATTCTCCCTGTCTTGGCCCCGGCTCCTGCCCACAGGCATCCGAGCCGAGCAGGTGAACAAGAAGGGA
ATCGAATTCTACAGTGATCTTATCGATGCCCTTCTGAGCAGCAACATCACTCCCATCGTGACCTTGCACCACTGG
GATCTGCCACAGCTGCTCCAGGTCAAATACGGTGGGTGGCAGAATGTGAGCATGGCCAACTACTTCAGAGACTAC
GCCAACCTGTGCTTTGAGGCCTTTGGGGACCGTGTGAAGCACTGGATCACGTTCAGTGATCCTCGGGCAATGGCA
GAAAAAGGCTATGAGACGGGCCACCATGCGCCGGGCCTGAAGCTCCGCGGCACCGGCCTGTACAAGGCAGCACAC
CACATCATTAAGGCCCACGCCAAAACCTGGCATTCTTATAACACCACGTGGCGCAGCAAGCAGCAAGGTCTGGTG
GGAATTTCACTGAACTGTGACTGGGGGGAACCTGTGGACATTAGTAACCCCAAGGACCTAGAGGCTGCCGAGAGA
TACCTACAGTTCTGTCTGGGCTGGTTTGCCAACCCCATTTATGCCGGTGACTACCCCCAAGTCATGAAGGACTAC
ATTGGAAGAAAGAGTGCAGAGCAAGGCCTGGAGATGTCGAGGTTACCGGTGTTCTCACTCCAGGAGAAGAGCTAC
ATTAAAGGCACATCCGATTTCTTGGGATTAGGTCATTTTACTACTCGGTACATCACGGAAAGGAACTACCCCTCC
CGCCAGGGGCCCAGCTACCAGAACGATCGTGACTTGATAGAGCTGGTTGACCCAAACTGGCCAGATCTGGGGTCT
AAATGGCTATATTCTGTGCCATGGGGATTTAGGAGGCTCCTTAACTTTGCTCAGACTCAATACGGTGATCCTCCC
ATATATGTGATGGAAAATGGAGCATCTCAAAAATTCCACTGTACTCAATTATGTGATGAGTGGAGAATTCAATAC
CTTAAAGGATACATAAATGAAATGCTAAAAGCTATAAAAGATGGTGCTAATATAAAGGGGTATACTTCCTGGTCT
CTGTTGGATAAGTTTGAATGGGAGAAAGGATACTCAGATAGATATGGATTCTACTATGTTGAATTTAACGACAGA
AATAAGCCTCGCTATCCAAAGGCTTCAGTTCAATATTACAAGAAGATTATCATTGCCAATGGGTTTCCCAATCCA
AGAGAGGTGGAAAGTTGGTACCTCAAAGCTTTGGAAACTTGCTCTATCAACAATCAGATGCTTGCTGCAGAGCCT
TTGCTAAGTCACATGCAAATGGTTACGGAGATCGTGGTACCCACTGTCTGCTCCCTCTGTGTCCTCATCACTGCT
GTTCTACTAATGCTCCTCCTGAGGAGGCAGAGCTGAGACAGGATTATCAATTTTGGAGCTTCATAAGAGAATCTT
CAGGATCTTCCTCCCTTTTCTGCTTTGAGGGTTTCCATACATTGCTGTTTTCAGGTTCTACAATAATTACCTTTT
TTTCTCTTTCTCTTTTTGGCTTGTGCTGGGATTTAAGAATTAGAAAATAAAAATAAGCAGAAATTA
```

FIGURE 254

```
MKPVWVATLLWMLLLVPRLGAARKGSPEEASFYYGTFPLGFSWGVGSSAYQTEGAWDQDGKGPSIWDVFTHSGKG
KVLGNETADVACDGYYKVQEDIILLRELHVNHYRFSLSWPRLLPTGIRAEQVNKKGIEFYSDLIDALLSSNITPI
VTLHHWDLPQLLQVKYGGWQNVSMANYFRDYANLCFEAFGDRVKHWITFSDPRAMAEKGYETGHHAPGLKLRGTG
LYKAAHHIIKAHAKTWHSYNTTWRSKQQGLVGISLNCDWGEPVDISNPKDLEAAERYLQFCLGWFANPIYAGDYP
QVMKDYIGRKSAEQGLEMSRLPVFSLQEKSYIKGTSDFLGLGHFTTRYITERNYPSRQGPSYQNDRDLIELVDPN
WPDLGSKWLYSVPWGFRRLLNFAQTQYGDPPIYVMENGASQKFHCTQLCDEWRIQYLKGYINEMLKAIKDGANIK
GYTSWSLLDKFEWEKGYSDRYGFYYVEFNDRNKPRYPKASVQYYKKIIIANGFPNPREVESWYLKALETCSINNQ
MLAAEPLLSHMQMVTEIVVPTVCSLCVLITAVLLMLLLRRQS
```

Important features:
Signal peptide:
amino acids 1-21

Transmembrane domain:
amino acids 541-558

N-glycosylation sites:
amino acids 80-84,171-175,245-249

Glycosaminoglycan attachment site:
amino acids 72-76 cAMP- and cGMP-dependent protein kinase phosphorylation sites:
amino acids 23-27,564-568

Tyrosine kinase phosphorylation sites:
amino acids 203-211,347-355,460-468,507-514

N-myristoylation sites:
amino acids 44-50,79-85,167-173,225-231,257-263,315-321

Amidation site:
amino acids 307-311

Glycosyl hydrolases family 1 active site:
amino acids 407-416

Glycosyl hydrolases family 1 N-terminal signature:
amino acids 41-56

Motif name Glycosyl hydrolases family:
amino acids 37- 67

FIGURE 255

CGCGAAG<u>ATG</u>CGAAAGGTGGTTTTGATCACCGGGGCTAGCAGTGGCATTGGCCTGGCCCTCTG
CAAGCGGCTGCTGGCGGAAGATGATGAGCTTCATCTGTGTTTGGCGTGCAGGAACATGAGCAA
GGCAGAAGCTGTCTGTGCTGCTCTGCTGGCCTCTCACCCCACTGCTGAGGTCACCATTGTCCA
GGTGGATGTCAGCAACCTGCAGTCGGTCTTCCGGGCCTCCAAGGAACTTAAGCAAAGGTTTCA
GAGATTAGACTGTATATATCTAAATGCTGGGATCATGCCTAATCCACAACTAAATATCAAAGC
ACTTTTCTTTGGCCTCTTTTCAAGAAAAGTGATTCATATGTTCTCCACAGCTGAAGGCCTGCT
GACCCAGGGTGATAAGATCACTGCTGATGGACTTCAGGAGGTGTTTGAGACCAATGTCTTTGG
CCATTTTATCCTGATTCGGGAACTGGAGCCTCTCCTCTGTCACAGTGACAATCCATCTCAGCT
CATCTGGACATCATCTCGCAGTGCAAGGAAATCTAATTTCAGCCTCGAGGACTTCCAGCACAG
CAAAGGCAAGGAACCCTACAGCTCTTCCAAATATGCCACTGACCTTTTGAGTGTGGCTTTGAA
CAGGAACTTCAACCAGCAGGGTCTCTATTCCAATGTGGCCTGTCCAGGTACAGCATTGACCAA
TTTGACATATGGAATTCTGCCTCCGTTTATATGGACGCTGTTGATGCCGGCAATATTGCTACT
TCGCTTTTTTGCAAATGCATTCACTTTGACACCATATAATGGAACAGAAGCTCTGGTATGGCT
TTTCCACCAAAAGCCTGAATCTCTCAATCCTCTGATCAAATATCTGAGTGCCACCACTGGCTT
TGGAAGAAATTATATTATGACCCAGAAGATGGACCTAGATGAAGACACTGCTGAAAAATTTTA
TCAAAAGTTACTGGAACTGGAAAAGCACATTAGGGTCACTATTCAAAAACAGATAATCAGGC
CAGGCTCAGTGGCTCATGCCTA<u>TAA</u>TTCCAGCACTTTGGGAGGCCAAGGCAGAAGGATCACTT
GAGACCAGGAGTTCAAGACCAGCCTGAGAAACATAGTGAGCCCTTGTCTCTACAAAAAGAAAT
AAAAATAATAGCTGGGTGTGGTGGCATGCGCATGTAGTCCCAGCTACTCAGAAGGATGAGGTG
GGAGGATCTCTTGAGGCTGGGAGGCAGAGGTTGCAGTGAGCTGAGATTGTGCCACTGCACTCC
AGCCTGGGTGACAGCGAGACCCTGTCTCAAAATATGTATATATTTAATATATATATAAAACCA
GAGCTGACAATGACACTCTGGAACATTGCATACCTTCTGTACATTCTGGGGTACATGGATTTC
TACTGAGTTGGATAATATGCATTTGTAATAAACTATGAACTATGAA

FIGURE 256

MRKVVLITGASSGIGLALCKRLLAEDDELHLCLACRNMSKAEAVCAALLASHPTAEVTIVQVD
VSNLQSVFRASKELKQRFQRLDCIYLNAGIMPNPQLNIKALFFGLFSRKVIHMFSTAEGLLTQ
GDKITADGLQEVFETNVFGHFILIRELEPLLCHSDNPSQLIWTSSRSARKSNFSLEDFQHSKG
KEPYSSSKYATDLLSVALNRNFNQQGLYSNVACPGTALTNLTYGILPPFIWTLLMPAILLLRF
FANAFTLTPYNGTEALVWLFHQKPESLNPLIKYLSATTGFGRNYIMTQKMDLDEDTAEKFYQK
LLELEKHIRVTIQKTDNQARLSGSCL

Important features:

Transmembrane domain:

amino acids 234-254

N-glycosylation sites:

amino acids 37-41,178-182,229-233,263-267

Glycosaminoglycan attachment site:

amino acids 12-16

N-myristoylation sites:

amino acids 9-15,13-19,15-21,215-221,224-230

FIGURE 257

```
CGGACGCGTGGGGCCGTATGCGCGGCTCTGTGGAGTGCACCTGGGGTTGGGGGCACTGTGCCC
CCAGCCCCCTGCTCCTTTGGACTCTACTTCTGTTTGCAGCCCCATTTGGCCTGCTGGGGGAGA
AGACCCGCCAGGTGTCTCTGGAGGTCATCCCTAACTGGCTGGGCCCCCTGCAGAACCTGCTTC
ATATACGGGCAGTGGGCACCAATTCCACACTGCACTATGTGTGGAGCAGCCTGGGGCCTCTGG
CAGTGGTAATGGTGGCCACCAACACCCCCACAGCACCCTGAGCATCAACTGGAGCCTCCTGC
TATCCCCTGAGCCCGATGGGGGCCTGATGGTGCTCCCTAAGGACAGCATTCAGTTTTCTTCTG
CCCTTGTTTTTACCAGGCTGCTTGAGTTTGACAGCACCAACGTGTCCGATACGGCAGCAAAGC
CTTTGGGAAGACCATATCCTCCATACTCCTTGGCCGATTTCTCTTGGAACAACATCACTGATT
CATTGGATCCTGCCACCCTGAGTGCCACATTTCAAGGCCACCCCATGAACGACCCTACCAGGA
CTTTTGCCAATGGCAGCCTGGCCTTCAGGGTCCAGGCCTTTTCCAGGTCCAGCCGACCAGCCC
AACCCCCTCGCCTCCTGCACACAGCAGACACCTGTCAGCTAGAGGTGGCCCTGATTGGAGCCT
CTCCCCGGGGAAACCGTTCCCTGTTTGGGCTGGAGGTAGCCACATTGGGCCAGGGCCCTGACT
GCCCCTCAATGCAGGAGCAGCACTCCATCGACGATGAATATGCACCGGCCGTCTTCCAGTTGG
ACCAGCTACTGTGGGGCTCCCTCCCATCAGGCTTTGCACAGTGGCGACCAGTGGCTTACTCCC
AGAAGCCGGGGGGCCGAGAATCAGCCCTGCCCTGCCAAGCTTCCCCTCTTCATCCTGCCTTAG
CATACTCTCTTCCCCAGTCACCCATTGTCCGAGCCTTCTTTGGGTCCCAGAATAACTTCTGTG
CCTTCAATCTGACGTTCGGGGCTTCCACAGGCCCTGGCTATTGGGACCAACACTACCTCAGCT
GGTCGATGCTCCTGGGTGTGGGCTTCCCTCCAGTGGACGGCTTGTCCCCACTAGTCCTGGGCA
TCATGGCAGTGGCCCTGGGTGCCCCAGGGCTCATGCTGCTAGGGGCGGCTTGGTTCTGCTGC
TGCACCACAAGAAGTACTCAGAGTACCAGTCCATAAATTAAGGCCCGCTCTCTGGAGGGAAGG
ACATTACTGAACCTGTCTTGCTGTGCCTCGAAACTCTGGAGGTTGGAGCATCAAGTTCCAGCC
GGCCCCTTCACTCCCCATCTTGCTTTTCTGTGGAACCTCAGAGGCCAGCCTCGACTTCCTGG
AGACCCCAGGTGGGGCTTCCTTCATACTTTGTTGGGGACTTTGGAGGCGGGCAGGGACAG
GGCTATTGATAAGGTCCCCTTGGTGTTGCCTTCTTGCATCTCCACACATTTCCCTTGGATGGG
ACTTGCAGGCCTAAATGAGAGGCATTCTGACTGGTTGGCTGCCCTGGAAGGCAAGAAAATAGA
TTTATTTTTTTTCACAGGGAAAAAAAAAAA
```

FIGURE 258

MRGSVECTWGWGHCAPSPLLLWTLLLFAAPFGLLGEKTRQVSLEVIPNWLGPLQNLLHIRAVG
TNSTLHYVWSSLGPLAVVMVATNTPHSTLSINWSLLLSPEPDGGLMVLPKDSIQFSSALVFTR
LLEFDSTNVSDTAAKPLGRPYPPYSLADFSWNNITDSLDPATLSATFQGHPMNDPTRTFANGS
LAFRVQAFSRSSRPAQPPRLLHTADTCQLEVALIGASPRGNRSLFGLEVATLGQGPDCPSMQE
QHSIDDEYAPAVFQLDQLLWGSLPSGFAQWRPVAYSQKPGGRESALPCQASPLHPALAYSLPQ
SPIVRAFFGSQNNFCAFNLTFGASTGPGYWDQHYLSWSMLLGVGFPPVDGLSPLVLGIMAVAL
GAPGLMLLGGGLVLLLHHKKYSEYQSIN

Important features:

Signal peptide:
amino acids 1-35

Transmembrane domain:
amino acids 365-386

N-glycosylation sites:
amino acids 65-69,95-99,134-138,159-163,187-191,230-234,333-337 cAMP- and cGMP-dependent protein kinase phosphorylation site:
amino acids 397-401

N-myristoylation sites:
amino acids 3-9,63-69,235-241,273-279,292-298,324-330

Leucine zipper pattern:
amino acids 371-393

FIGURE 259

CAGGCGGGCCCCCGCGCGGCAGGGCCCTGGACCCGCGCGGCTCCCGGGG<u>ATG</u>GTGAGCAAGGCGCTGCTGCGCCT
CGTGTCTGCCGTCAACCGCAGGAGGATGAAGCTGCTGCTGGGCATCGCCTTGCTGGCCTACGTCGCCTCTGTTTG
GGGCAACTTCGTTAATATGAGGTCTATCCAGGAAAATGGTGAACTAAAAATTGAAAGCAAGATTGAAGAGATGGT
TGAACCACTAAGAGAGAAAATCAGAGATTTAGAAAAAAGCTTTACCCAGAAATACCCACCAGTAAAGTTTTTATC
AGAAAAGGATCGGAAAAGAATTTTGATAACAGGAGGCGCAGGGTTCGTGGGCTCCCATCTAACTGACAAACTCAT
GATGGACGGCCACGAGGTGACCGTGGTGGACAATTTCTTCACGGGCAGGAAGAGAAACGTGGAGCACTGGATCGG
ACATGAGAACTTCGAGTTGATTAACCACGACGTGGTGGAGCCCCTCTACATCGAGGTTGACCAGATATACCATCT
GGCATCTCCAGCCTCCCCTCCAAACTACATGTATAATCCTATCAAGACATTAAAGACCAATACGATTGGGACATT
AAACATGTTGGGGCTGGCAAAACGAGTCGGTGCCCGTCTGCTCCTGGCCTCCACATCGGAGGTGTATGGAGATCC
TGAAGTCCACCCTCAAAGTGAGGATTACTGGGGCCACGTGAATCCAATAGGACCTCGGGCCTGCTACGATGAAGG
CAAACGTGTTGCAGAGACCATGTGCTATGCCTACATGAAGCAGGAAGGCGTGGAAGTGCGAGTGGCCAGAATCTT
CAACACCTTTGGGCCACGCATGCACATGAACGATGGGCGAGTAGTCAGCAACTTCATCCTGCAGGCGCTCCAGGG
GGAGCCACTCACGGTATACGGATCCGGTCTCAGACAAGGGCGTTCCAGTACGTCAGCGATCTAGTGAATGGCCT
CGTGGCTCTCATGAACAGCAACGTCAGCAGCCCGGTCAACCTGGGGAACCCAGAAGAACACACAATCCTAGAATT
TGCTCAGTTAATTAAAAACCTTGTTGGTAGCGGAAGTGAAATTCAGTTTCTCTCCGAAGCCCAGGATGACCCACA
GAAAAGAAAACCAGACATCAAAAAAGCAAAGCTGATGCTGGGGTGGGAGCCCGTGGTCCCGCTGGAGGAAGGTTT
AAACAAAGCAATTCACTACTTCCGTAAAGAACTCGAGTACCAGGCAAATAATCAGTACATCCCCAAACCAAAGCC
TGCCAGAATAAAGAAAGGACGGACTCGCCACAGC<u>TGA</u>ACTCCTCACTTTTAGGACACAAGACTACCATTGTACAC
TTGATGGGATGTATTTTTGGCTTTTTTTTGTTGTCGTTTAAAGAAAGACTTTAACAGGTGTCATGAAGAACAAAC
TGGAATTTCATTCTGAAGCTTGCTTTAATGAAATGGATGTGCCTAAAAGCTCCCCTCAAAAAACTGCAGATTTTG
CCTTGCACTTTTTGAATCTCTCTTTTTATGTAAAATAGCGTAGATGCATCTCTGCGTATTTTCAAGTTTTTTTAT
CTTGCTGTGAGAGCATATGTTGTGACTGTCGTTGACAGTTTTATTTACTGGTTTCTTTGTGAAGCTGAAAAGGAA
CATTAAGCGGGACAAAAAATGCCGATTTTATTTATAAAAGTGGGTACTTAATAAATGAGTCGTTATACTATGCAT
AAAGAAAAATCCTAGCAGTATTGTCAGGTGGTGGTGCGCCGGCATTGATTTTAGGGCAGATAAAAGAATTCTGTG
TGAGAGCTTTATGTTTCTCTTTTAATTCAGAGTTTTTCCAAGGTCTACTTTTGAGTTGCAAACTTGACTTTGAAA
TATTCCTGTTGGTCATGATCAAGGATATTTGAAATCACTACTGTGTTTTGCTGCGTATCTGGGCGGGGGCAGGT
TGGGGGGCACAAAGTTAACATATTCTTGGTTAACCATGGTTAAATATGCTATTTTAATAAAATATTGAAACTCA

FIGURE 260

MVSKALLRLVSAVNRRRMKLLLGIALLAYVASVWGNFVNMRSIQENGELKIESKIEEMVEPLR
EKIRDLEKSFTQKYPPVKFLSEKDRKRILITGGAGFVGSHLTDKLMMDGHEVTVVDNFFTGRK
RNVEHWIGHENFELINHDVVEPLYIEVDQIYHLASPASPPNYMYNPIKTLKTNTIGTLNMLGL
AKRVGARLLLASTSEVYGDPEVHPQSEDYWGHVNPIGPRACYDEGKRVAETMCYAYMKQEGVE
VRVARIFNTFGPRMHMNDGRVVSNFILQALQGEPLTVYGSGSQTRAFQYVSDLVNGLVALMNS
NVSSPVNLGNPEEHTILEFAQLIKNLVGSGSEIQFLSEAQDDPQKRKPDIKKAKLMLGWEPVV
PLEEGLNKAIHYFRKELEYQANNQYIPKPKPARIKKGRTRHS

Important features:

Signal peptide:
amino acids 1-32

N-glycosylation site:
amino acids 316-320

Tyrosine kinase phosphorylation site:
amino acids 235-244

N-myristoylation sites:
amino acids 35-41,101-107,383-389

Amidation sites:
amino acids 123-127,233-237

FIGURE 261

GCGTGGTGCGGGGGCGTGGGGAAATCGGGTTGCCCCAGCCGTTACTGGTCCGCGCAGTCAGGG
CATCCTCCGCATCCTCCACATCCTTCC<u>ATG</u>GCTCTGAAGAATAAATTCAGTTGTTTATGGATC
TTGGGTCTGTGTTTGGTAGCCACTACATCTTCCAAAATCCCATCCATCACTGACCCACACTTT
ATAGACAACTGCATAGAAGCCCACAACGAATGGCGTGGCAAAGTCAACCCTCCCGCGGCCGAC
ATGAAATACATGATTTGGGATAAAGGTTTAGCAAAGATGGCTAAAGCATGGGCAAACCAGTGC
AAATTTGAACATAATGACTGTTTGGATAAATCATATAAATGCTATGCAGCTTTTGAATATGTT
GGAGAAATATCTGGTTAGGTGGAATAAAGTCATTCACACCAAGACATGCCATTACGGCTTGG
TATAATGAAACCCAATTTTATGATTTGATAGTCTATCATGCTCCAGAGTCTGTGGCCATTAT
ACACAGTTAGTTTGGGCCAATTCATTTTATGTCGGTTGTGCAGTTGCAATGTGTCCTAACCTT
GGGGGAGCTTCAACTGCAATATTTGTATGCAACTACGGACCTGCAGGAAATTTTGCAAATATG
CCTCCTTACGCAAGAGGAGAATCTTGCTCTCTCTGCTCAAAAGAAGAGAAATGTGTAAAGAAC
CTCTGCAGGACTCCACAACTTATTATACCTAACCAAAATCCATTTCTGAAGCCAACGGGGAGA
GCACCTCAGCAGACAGCCTTTAATCCATTCAGCTTAGGTTTTCTTCTTCTGAGAATCTTT<u>TAA</u>
TGTCATTTATATACAAAAGAAATTCTCAAATGTTAAATAAGGAATAGTTTATTGCTTAATA

FIGURE 262

MALKNKFSCLWILGLCLVATTSSKIPSITDPHFIDNCIEAHNEWRGKVNPPAADMKYMIWDKG
LAKMAKAWANQCKFEHNDCLDKSYKCYAAFEYVGENIWLGGIKSFTPRHAITAWYNETQFYDF
DSLSCSRVCGHYTQLVWANSFYVGCAVAMCPNLGGASTAIFVCNYGPAGNFANMPPYARGESC
SLCSKEEKCVKNLCRTPQLIIPNQNPFLKPTGRAPQQTAFNPFSLGFLLLRIF

Important features:

Signal peptide:

amino acids 1-23

N-glycosylation site:

amino acids 119-123

N-myristoylation sites:

amino acids 103-109,150-156,160-166,161-167,175-181

Extracellular proteins SCP/Tpx-1/Ag5/PR-1/Sc7 signature 1:

amino acids 136-156

Extracellular proteins SCP/Tpx-1/Ag5/PR-1/Sc7 signature 2:

amino acids 166-178

FIGURE 263

```
CGCCCTCCGACCCGCCCCGCGGCGCATTGTGGGATCTGTCGGCTTGTCAGGTGGTGGAGGAAA
AGGCGCTCCGTCATGGGGATCCAGACGAGCCCCGTCCTGCTGGCCTCCCTGGGGGTGGGGCTG
GTCACTCTGCTCGGCCTGGCTGTGGGCTCCTACTTGGTTCGGAGGTCCCGCCGGCCTCAGGTC
ACTCTCCTGGACCCCAATGAAAAGTACCTGCTACGACTGCTAGACAAGACGACTGTGAGCCAC
AACACCAAGAGGTTCCGCTTTGCCCTGCCCACCGCCCACCACACTCTGGGGCTGCCTGTGGGC
AAACATATCTACCTCTCCACCCGAATTGATGGCAGCCTGGTCATCAGGCCATACACTCCTGTC
ACCAGTGATGAGGATCAAGGCTATGTGGATCTTGTCATCAAGGTCTACCTGAAGGGTGTGCAC
CCCAAATTTCCTGAGGGAGGGAAGATGTCTCAGTACCTGGATAGCCTGAAGGTTGGGGATGTG
GTGGAGTTTCGGGGGCCAAGCGGGTTGCTCACTTACACTGGAAAAGGGCATTTTAACATTCAG
CCCAACAAGAAATCTCCACCAGAACCCCGAGTGGCGAAGAAACTGGGAATGATTGCCGGCGGG
ACAGGAATCACCCCAATGCTACAGCTGATCCGGGCCATCCTGAAAGTCCCTGAAGATCCAACC
CAGTGCTTTCTGCTTTTTGCCAACCAGACAGAAAAGGATATCATCTTGCGGGAGGACTTAGAG
GAACTGCAGGCCCGCTATCCCAATCGCTTTAAGCTCTGGTTCACTCTGGATCATCCCCCAAAA
GATTGGGCCTACAGCAAGGGCTTTGTGACTGCCGACATGATCCGGGAACACCTGCCCGCTCCA
GGGGATGATGTGCTGGTACTGCTTTGTGGGCCACCCCAATGGTGCAGCTGGCCTGCCATCCC
AACTTGGACAAACTGGGCTACTCACAAAGATGCGATTCACCTACTGAGCATCCTCCAGCTTC
CCTGGTGCTGTTCGCTGCAGTTGTTCCCCATCAGTACTCAAGCACTATAAGCCTTAGATTCCT
TTCCTCAGAGTTTCAGGTTTTTTCAGTTACATCTAGAGCTGAAATCTGGATAGTACCTGCAGG
AACAATATTCCTGTAGCCATGGAAGAGGGCAAGGCTCAGTCACTCCTTGGATGGCCTCCTAAA
TCTCCCCGTGGCAACAGGTCCAGGAGAGGCCCATGGAGCAGTCTCTTCCATGGAGTAAGAAGG
AAGGGAGCATGTACGCTTGGTCCAAGATTGGCTAGTTCCTTGATAGCATCTTACTCTCACCTT
CTTTGTGTCTGTGATGAAAGGAACAGTCTGTGCAATGGGTTTTACTTAAACTTCACTGTTCAA
CCTATGAGCAAATCTGTATGTGTGAGTATAAGTTGAGCATAGCATACTTCCAGAGGTGGTNTT
ATGGAGATGGCAAGAAAGGAGGAAATGATTTCTTCAGATNTCAAAGGAGTCTGAAATATCATA
TTTCTGTGTGTGTCTCTCAGCCCCTGCCCAGGCTAGAGGGAAACAGCTACTGATAATCGAA
AACTGCTGTTTGTGGCANGAACCCCTGGCTGTGCAAATAAATGGGGCTGAGGCCCCTGTGTGA
TATTGAAAAAAAAAAAAAAAAAAAAAAAAAAAAAAAAAAAAAAAAAGA
```

FIGURE 264

MGIQTSPVLLASLGVGLVTLLGLAVGSYLVRRSRRPQVTLLDPNEKYLLRLLDKTTVSHNTKR
FRFALPTAHHTLGLPVGKHIYLSTRIDGSLVIRPYTPVTSDEDQGYVDLVIKVYLKGVHPKFP
EGGKMSQYLDSLKVGDVVEFRGPSGLLTYTGKGHFNIQPNKKSPPEPRVAKKLGMIAGGTGIT
PMLQLIRAILKVPEDPTQCFLLFANQTEKDIILREDLEELQARYPNRFKLWFTLDHPPKDWAY
SKGFVTADMIREHLPAPGDDVLVLLCGPPPMVQLACHPNLDKLGYSQKMRFTY

Important features:

Signal peptide:

amino acids 1-26

N-glycosylation site:

amino acids 214-218

N-myristoylation sites:

amino acids 22-28,76-82,128-134,180-186

FIGURE 265

CCCGTGCCAAGAGTGACGTAAGTACCGCCTATAGAGTCTATAGGCCCACTTGGCTTCGTTAGA
ACGCGGCTACAATTAATACATAACCTTATGTATCATACACATACGATTTAGGTGACACTATAG
AATAACATCCACTTTGCCTTTCTCTCCACAGGTGTCCACTCCCAGGTCCAACTGCACCTCGGT
TCTATCGATAATCTCAGCACCAGCCACTCAGAGCAGGGCACATGTTGGGGGCCCGCCTCAGG
CTCTGGGTCTGTGCCTTGTGCAGCGTCTGCAGCATGAGCGTCCTCAGAGCCTATCCCAATGCC
TCCCCACTGCTCGGCTCCAGCTGGGGTGGCCTGATCCACCTGTACACAGCCACAGCCAGGAAC
AGCTACCACCTGCAGATCCACAAGAATGGCCATGTGGATGGCGCACCCCATCAGACCATCTAC
AGTGCCCTGATGATCAGATCAGAGGATGCTGGCTTTGTGGTGATTACAGGTGTGATGAGCAGA
AGATACCTCTGCATGGATTTCAGAGGCAACATTTTTGGATCACACTATTTCGACCCGGAGAAC
TGCAGGTTCCAACACCAGACGCTGGAAAACGGGTACGACGTCTACCACTCTCCTCAGTATCAC
TTCCTGGTCAGTCTGGGCCGGGCGAAGAGAGCCTTCCTGCCAGGCATGAACCCACCCCCGTAC
TCCCAGTTCCTGTCCCGGAGGAACGAGATCCCCCTAATTCACTTCAACACCCCCATACCACGG
CGGCACACCCGGAGCGCCGAGGACGACTCGGAGCGGGACCCCCTGAACGTGCTGAAGCCCCGG
GCCCGGATGACCCCGGCCCCGGCCTCCTGTTCACAGGAGCTCCCGAGCGCCGAGGACAACAGC
CCGATGGCCAGTGACCCATTAGGGGTGGTCAGGGGCGGTCGAGTGAACACGCACGCTGGGGGA
ACGGGCCCGGAAGGCTGCCGCCCCTTCGCCAAGTTCATCTAGGGTCGCTGG

FIGURE 266

MLGARLRLWVCALCSVCSMSVLRAYPNASPLLGSSWGGLIHLYTATARNSYHLQIHKNGHVDG
APHQTIYSALMIRSEDAGFVVITGVMSRRYLCMDFRGNIFGSHYFDPENCRFQHQTLENGYDV
YHSPQYHFLVSLGRAKRAFLPGMNPPPYSQFLSRRNEIPLIHFNTPIPRRHTRSAEDDSERDP
LNVLKPRARMTPAPASCSQELPSAEDNSPMASDPLGVVRGGRVNTHAGGTGPEGCRPFAKFI

Important features:

Signal peptide:

amino acids 1-24 cAMP- and cGMP-dependent protein kinase phosphorylation site.

amino acids 175-179

N-myristoylation site.

amino acids 33-39, 100-106, 225-231, 229-235

HBGF/FGF family proteins amino acids 73-124

FIGURE 267

```
GGCTGAGGGGAGGCCCGGAGCCTTTCTGGGGCCTGGGGGATCCTCTTGCACTGGTGGGTGGAGAGAAGCGCCTGC
AGCCAACCAGGGTCAGGCTGTGCTCACAGTTTCCTCTGGCGGCATGTAAAGGCTCCACAAAGGAGTTGGGAGTTC
AAATGAGGCTGCTGCGGACGGCCTGAGGATGGACCCCAAGCCCTGGACCTGCCGAGCGTGGCACTGAGGCAGCGG
CTGACGCTACTGTGAGGGAAAGAAGGTTGTGAGCAGCCCCGCAGGACCCCTGGCCAGCCCTGGCCCCAGCCTCTG
CCGGAGCCCTCTGTGGAGGCAGAGCCAGTGGAGCCCAGTGAGGCAGGGCTGCTTGGCAGCCACCGGCCTGCAACT
CAGGAACCCCTCCAGAGGCCATGGACAGGCTGCCCCGCTGACGGCCAGGGTGAAGCATGTGAGGAGCCGCCCCGG
AGCCAAGCAGGAGGGAAGAGGCTTTCATAGATTCTATTCACAAAGAATAACCACCATTTTGCAAGGACCATGAGG
CCACTGTGCGTGACATGCTGGTGGCTCGGACTGCTGGCTGCCATGGGAGCTGTTGCAGGCCAGGAGGACGGTTTT
GAGGGCACTGAGGAGGGCTCGCCAAGAGAGTTCATTTACCTAAACAGGTACAAGCGGGCGGGCGAGTCCCAGGAC
AAGTGCACCTACACCTTCATTGTGCCCCAGCAGCGGGTCACGGGTGCCATCTGCGTCAACTCCAAGGAGCCTGAG
GTGCTTCTGGAGAACCGAGTGCATAAGCAGGAGCTAGAGCTGCTCAACAATGAGCTGCTCAAGCAGAAGCGGCAG
ATCGAGACGCTGCAGCAGCTGGTGGAGGTGGACGGCGGCATTGTGAGCGAGGTGAAGCTGCTGCGCAAGGAGAGC
CGCAACATGAACTCGCGGGTCACGCAGCTCTACATGCAGCTCCTGCACGAGATCATCCGCAAGCGGGACAACGCG
TTGGAGCTCTCCCAGCTGGAGAACAGGATCCTGAACCAGACAGCCGACATGCTGCAGCTGGCCAGCAAGTACAAG
GACCTGGAGCACAAGTACCAGCACCTGGCCACACTGGCCCACAACCAATCAGAGATCATCGCGCAGCTTGAGGAG
CACTGCCAGAGGGTGCCCTCGGCCAGGCCCGTCCCCCAGCCACCCCCGCTGCCCCGCCCCGGGTCTACCAACCA
CCCACCTACAACCGCATCATCAACCAGATCTCTACCAACGAGATCCAGAGTGACCAGAACCTGAAGGTGCTGCCA
CCCCCTCTGCCCACTATGCCCACTCTCACCAGCCTCCCATCTTCCACCGACAAGCCGTCGGGCCCATGGAGAGAC
TGCCTGCAGGCCCTGGAGGATGGCCACGACACCAGCTCCATCTACCTGGTGAAGCCGGAGAACACCAACCGCCTC
ATGCAGGTGTGGTGCGACCAGAGACACGACCCCGGGGGCTGGACCGTCATCCAGAGACGCCTGGATGGCTCTGTT
AACTTCTTCAGGAACTGGGAGACGTACAAGCAAGGGTTTGGGAACATTGACGGCGAATACTGGCTGGGCCTGGAG
AACATTTACTGGCTGACGAACCAAGGCAACTACAAACTCCTGGTGACCATGGAGGACTGGTCCGGCCGCAAAGTC
TTTGCAGAATACGCCAGTTTCCGCCTGGAACCTGAGAGCGAGTATTATAAGCTGCGGCTGGGGCGCTACCATGGC
AATGCGGGTGACTCCTTTACATGGCACAACGGCAAGCAGTTCACCACCCTGGACAGAGATCATGATGTCTACACA
GGAAACTGTGCCCACTACCAGAAGGGAGGCTGGTGGTATAACGCCTGTGCCCACTCCAACCTCAACGGGGTCTGG
TACCGCGGGGGCCATTACCGGAGCCGCTACCAGGACGGAGTCTACTGGGCTGAGTTCCGAGGAGGCTCTTACTCA
CTCAAGAAAGTGGTGATGATGATCCGACCGAACCCCAACACCTTCCACTAAGCCAGCTCCCCCTCCTGACCTCTC
GTGGCCATTGCCAGGAGCCCACCCTGGTCACGCTGGCCACAGCACAAAGAACAACTCCTCACCAGTTCATCCTGA
GGCTGGGAGGACCGGGATGCTGGATTCTGTTTTCCGAAGTCACTGCAGCGGATGATGGAACTGAATCGATACGGT
GTTTTCTGTCCCTCCTACTTTCCTTCACACCAGACAGCCCCTCATGTCTCCAGGACAGGACAGGACTACAGACAA
CTCTTTCTTTAAATAAATTAAGTCTCTACAATAAAAAAA
```

FIGURE 268

```
MRPLCVTCWWLGLLAAMGAVAGQEDGFEGTEEGSPREFIYLNRYKRAGESQDKCTYTFIVPQQ
RVTGAICVNSKEPEVLLENRVHKQELELLNNELLKQKRQIETLQQLVEVDGGIVSEVKLLRKE
SRNMNSRVTQLYMQLLHEIIRKRDNALELSQLENRILNQTADMLQLASKYKDLEHKYQHLATL
AHNQSEIIAQLEEHCQRVPSARPVPQPPPAAPPRVYQPPTYNRIINQISTNEIQSDQNLKVLP
PPLPTMPTLTSLPSSTDKPSGPWRDCLQALEDGHDTSSIYLVKPENTNRLMQVWCDQRHDPGG
WTVIQRRLDGSVNFFRNWETYKQGFGNIDGEYWLGLENIYWLTNQGNYKLLVTMEDWSGRKVF
AEYASFRLEPESEYYKLRLGRYHGNAGDSFTWHNGKQFTTLDRDHDVYTGNCAHYQKGGWWYN
ACAHSNLNGVWYRGGHYRSRYQDGVYWAEFRGGSYSLKKVVMMIRPNPNTFH
```

Important features:

Signal peptide:
amino acids 1-22

N-glycosylation sites:
amino acids 164-168,192-196 cAMP- and cGMP-dependent protein kinase phosphorylation site:
amino acids 124-128

Tyrosine kinase phosphorylation sites:
amino acids 177-184,385-393,385-394,461-468

N-myristoylation sites:
amino acids 12-18,18-24,22-28,29-35,114-120,341-347,465-471, 473-479

Amidation site:
amino acids 373-377

Fibrinogen beta and gamma chains C-terminal domain signature:
amino acids 438-451

Fibrinogen beta and gamma chains C-terminal domain proteins:
amino acids 305-343, 365-402, 411-424, 428-458

Trehalase proteins:
amino acids 275-292

FIGURE 269

GCCGAGCTGAGCGGATCCTCAC<u>ATG</u>ACTGTGATCCGATTCTTTCCAGCGGCTTCTGCAACCAA
GCGGGTCTTACCCCCGGTCCTCCGCGTCTCCAGTCCTCGCACCTGGAACCCCAACGTCCCCGA
GAGTCCCCGAATCCCCGCTCCCAGGCTACCTAAGAGGATGAGCGGTGCTCCGACGGCCGGGGC
AGCCCTGATGCTCTGCGCCGCCACCGCCGTGCTACTGAGCGCTCAGGGCGGACCCGTGCAGTC
CAAGTCGCCGCGCTTTGCGTCCTGGGACGAGATGAATGTCCTGGCGCACGGACTCCTGCAGCT
CGGCCAGGGGCTGCGCGAACACGCGGAGCGCACCCGCAGTCAGCTGAGCGCGCTGGAGCGGCG
CCTGAGCGCGTGCGGGTCCGCCTGTCAGGGAACCGAGGGGTCCACCGACCTCCCGTTAGCCCC
TGAGAGCCGGGTGGACCCTGAGGTCCTTCACAGCCTGCAGACACAACTCAAGGCTCAGAACAG
CAGGATCCAGCAACTCTTCCACAAGGTGGCCCAGCAGCAGCGGCACCTGGAGAAGCAGCACCT
GCGAATTCAGCATCTGCAAAGCCAGTTTGGCCTCCTGGACCACAAGCACCTAGACCATGAGGT
GGCCAAGCCTGCCCGAAGAAAGAGGCTGCCCGAGATGGCCCAGCCAGTTGACCCGGCTCACAA
TGTCAGCCGCCTGCACCGGCTGCCCAGGGATTGCCAGGAGCTGTTCCAGGTTGGGGAGAGGCA
GAGTGGACTATTTGAAATCCAGCCTCAGGGTCTCCGCCATTTTTGGTGAACTGCAAGATGAC
CTCAGATGGAGGCTGGACAGTAATTCAGAGGCGCCACGATGGCTCAGTGGACTTCAACCGGCC
CTGGGAAGCCTACAAGGCGGGGTTTGGGGATCCCCACGGCGAGTTCTGGCTGGGTCTGGAGAA
GGTGCATAGCATCACGGGGGACCGCAACAGCCGCCTGGCCGTGCAGCTGCGGGACTGGGATGG
CAACGCCGAGTTGCTGCAGTTCTCCGTGCACCTGGGTGGCGAGGACACGGCCTATAGCCTGCA
GCTCACTGCACCCGTGGCCGGCCAGCTGGGCGCCACCACCGTCCCACCCAGCGGCCTCTCCGT
ACCCTTCTCCACTTGGGACCAGGATCACGACCTCCGCAGGGACAAGAACTGCGCCAAGAGCCT
CTCTGGAGGCTGGTGGTTTGGCACCTGCAGCCATTCCAACCTCAACGGCCAGTACTTCCGCTC
CATCCCACAGCAGCGGCAGAAGCTTAAGAAGGGAATCTTCTGGAAGACCTGGCGGGGCCGCTA
CTACCCGCTGCAGGCCACCACCATGTTGATCCAGCCCATGGCAGCAGAGGCAGCCTCC<u>TAG</u>CG
TCCTGGCTGGGCCTGGTCCCAGGCCCACGAAAGACGGTGACTCTTGGCTCTGCCCGAGGATGT
GGCCGTTCCCTGCCTGGGCAGGGCTCCAAGGAGGGCCATCTGGAAACTTGTGGACAGAGAA
GAAGACCACGACTGGAGAAGCCCCCTTTCTGAGTGCAGGGGGGCTGCATGCGTTGCCTCCTGA
GATCGAGGCTGCAGGATATGCTCAGACTCTAGAGGCGTGGACCAAGGGGCATGGAGCTTCACT
CCTTGCTGGCCAGGGAGTTGGGGACTCAGAGGGACCACTTGGGCCAGCCAGACTGGCCTCAA
TGGCGGACTCAGTCACATTGACTGACGGGGACCAGGGCTTGTGTGGGTCGAGAGCGCCCTCAT
GGTGCTGGTGCTGTTGTGTGTAGGTCCCTGGGGACACAAGCAGGCGCCAATGGTATCTGGGC
GGAGCTCACAGAGTTCTTGGAATAAAAGCAACCTCAGAACAC

FIGURE 270

MTVIRFFPAASATKRVLPPVLRVSSPRTWNPNVPESPRIPAPRLPKRMSGAPTAGAALMLCAA
TAVLLSAQGGPVQSKSPRFASWDEMNVLAHGLLQLGQGLREHAERTRSQLSALERRLSACGSA
CQGTEGSTDLPLAPESRVDPEVLHSLQTQLKAQNSRIQQLFHKVAQQQRHLEKQHLRIQHLQS
QFGLLDHKHLDHEVAKPARRKRLPEMAQPVDPAHNVSRLHRLPRDCQELFQVGERQSGLFEIQ
PQGSPPFLVNCKMTSDGGWTVIQRRHDGSVDFNRPWEAYKAGFGDPHGEFWLGLEKVHSITGD
RNSRLAVQLRDWDGNAELLQFSVHLGGEDTAYSLQLTAPVAGQLGATTVPPSGLSVPFSTWDQ
DHDLRRDKNCAKSLSGGWWFGTCSHSNLNGQYFRSIPQQRQKLKKGIFWKTWRGRYYPLQATT
MLIQPMAAEAAS

Important features:
Signal peptide:
Amino acids 1-13

Transmembrane domain:
Amino acids 53-70

N-glycosylation site:
Amino acids 224-228 cAMP- and cGMP-dependent protein kinase phosphorylation sites:
Amino acids 46-50;118-122

N-myristoylation sites:
Amino acids 50-56;129-135;341-347;357-363

Fibrinogen beta and gamma chains C-terminal domain signature:
Amino acids 396-409

FIGURE 271

CGGACGCGTGGGGGAAACCCTTCCGAGAAAACAGCAACAAGCTGAGCTGCTGTGACAGAGGGG
AACAAG<u>ATG</u>GCGGCGCCGAAGGGGAGCCTCTGGGTGAGGACCCAACTGGGGCTCCCGCCGCTG
CTGCTGCTGACCATGGCCTTGGCCGGAGGTTCGGGGACCGCTTCGGCTGAAGCATTTGACTCG
GTCTTGGGTGATACGGCGTCTTGCCACCGGGCCTGTCAGTTGACCTACCCCTTGCACACCTAC
CCTAAGGAAGAGGAGTTGTACGCATGTCAGAGAGGTTGCAGGCTGTTTTCAATTTGTCAGTTT
GTGGATGATGGAATTGACTTAAATCGAACTAAATTGGAATGTGAATCTGCATGTACAGAAGCA
TATTCCCAATCTGATGAGCAATATGCTTGCCATCTTGGTTGCCAGAATCAGCTGCCATTCGCT
GAACTGAGACAAGAACAACTTATGTCCCTGATGCCAAAAATGCACCTACTCTTTCCTCTAACT
CTGGTGAGGTCATTCTGGAGTGACATGATGGACTCCGCACAGAGCTTCATAACCTCTTCATGG
ACTTTTTATCTTCAAGCCGATGACGGAAAAATAGTTATATTCCAGTCTAAGCCAGAAATCCAG
TACGCACCACATTTGGAGCAGGAGCCTACAAATTTGAGAGAATCATCTCTAAGCAAAATGTCC
TATCTGCAAATGAGAAATTCACAAGCGCACAGGAATTTTCTTGAAGATGGAGAAAGTGATGGC
TTTTTAAGATGCCTCTCTCTTAACTCTGGGTGGATTTTAACTACAACTCTTGTCCTCTCGGTG
ATGGTATTGCTTTGGATTTGTTGTGCAACTGTTGCTACAGCTGTGGAGCAGTATGTTCCCTCT
GAGAAGCTGAGTATCTATGGTGACTTGGAGTTTATGAATGAACAAAAGCTAAACAGATATCCA
GCTTCTTCTCTTGTGGTTGTTAGATCTAAAACTGAAGATCATGAAGAAGCAGGGCCTCTACCT
ACAAAAGTGAATCTTGCTCATTCTGAAATT<u>TAA</u>GCATTTTCTTTTAAAAGACAAGTGTAATA
GACATCTAAAATTCCACTCCTCATAGAGCTTTTAAAATGGTTTCATTGGATATAGGCCTTAAG
AAATCACTATAAAATGCAAATAAAGTTACTCAAATCTGTG

FIGURE 272

MAAPKGSLWVRTQLGLPPLLLLTMALAGGSGTASAEAFDSVLGDTASCHRACQLTYPLHTYPK
EEELYACQRGCRLFSICQFVDDGIDLNRTKLECESACTEAYSQSDEQYACHLGCQNQLPFAEL
RQEQLMSLMPKMHLLFPLTLVRSFWSDMMDSAQSFITSSWTFYLQADDGKIVIFQSKPEIQYA
PHLEQEPTNLRESSLSKMSYLQMRNSQAHRNFLEDGESDGFLRCLSLNSGWILTTTLVLSVMV
LLWICCATVATAVEQYVPSEKLSIYGDLEFMNEQKLNRYPASSLVVVRSKTEDHEEAGPLPTK
VNLAHSEI

Important features:

Signal peptide:
amino acids 1-31

Transmembrane domain:
amino acids 241-260

N-glycosylation site:
amino acids 90-94

N-myristoylation sites:
amino acids 28-34,29-35,31-37,86-92

FIGURE 273

CCCACGCGTCCGAACCTCTCCAGCGATGGGAGCCGCCCGCCTGCTGCCCAACCTCACTCTGTG
CTTACAGCTGCTGATTCTCTGCTGTCAAACTCAGTACGTGAGGGACCAGGGCGCCATGACCGA
CCAGCTGAGCAGGCGGCAGATCCGCGAGTACCAACTCTACAGCAGGACCAGTGGCAAGCACGT
GCAGGTCACCGGGCGTCGCATCTCCGCCACCGCCGAGGACGGCAACAAGTTTGCCAAGCTCAT
AGTGGAGACGGACACGTTTGGCAGCGGGTTCGCATCAAGGGGCTGAGAGTGAGAAGTACAT
CTGTATGAACAAGAGGGGCAAGCTCATCGGGAAGCCCAGCGGGAAGAGCAAAGACTGCGTGTT
CACGGAGATCGTGCTGGAGAACAACTATACGGCCTTCCAGAACGCCCGGCACGAGGGCTGGTT
CATGGCCTTCACGCGGCAGGGGCGGCCCCGCCAGGCTTCCCGCAGCCGCCAGAACCAGCGCGA
GGCCCACTTCATCAAGCGCCTCTACCAAGGCCAGCTGCCCTTCCCCAACCACGCCGAGAAGCA
GAAGCAGTTCGAGTTTGTGGGCTCCGCCCCCACCCGCCGGACCAAGCGCACACGGCGGCCCCA
GCCCCTCACGTAGTCTGGGAGGCAGGGGGCAGCAGCCCCTGGGCCGCCTCCCCACCCCTTTCC
CTTCTTAATCCAAGGACTGGGCTGGGGTGGCGGGAGGGGAGCCAGATCCCCGAGGGAGGACCC
TGAGGGCCGCGAAGCATCCGAGCCCCCAGCTGGGAAGGGGCAGGCCGGTGCCCCAGGGGCGGC
TGGCACAGTGCCCCCTTCCCGGACGGGTGGCAGGCCTGGAGAGGAACTGAGTGTCACCCTGA
TCTCAGGCCACCAGCCTCTGCCGGCCTCCCAGCCGGGCTCCTGAAGCCCGCTGAAAGGTCAGC
GACTGAAGGCCTTGCAGACAACCGTCTGGAGGTGGCTGTCCTCAAAATCTGCTTCTCGGATCT
CCCTCAGTCTGCCCCCAGCCCCCAAACTCCTCCTGGCTAGACTGTAGGAAGGGACTTTTGTTT
GTTTGTTTGTTTCAGGAAAAAAGAAAGGGAGAGAGAGGAAAATAGAGGGTTGTCCACTCCTCA
CATTCCACGACCCAGGCCTGCACCCCACCCCCAACTCCCAGCCCGGAATAAAACCATTTTCC
TGC

FIGURE 274

MGAARLLPNLTLCLQLLILCCQTQYVRDQGAMTDQLSRRQIREYQLYSRTSGKHVQVTGRRIS
ATAEDGNKFAKLIVETDTFGSRVRIKGAESEKYICMNKRGKLIGKPSGKSKDCVFTEIVLENN
YTAFQNARHEGWFMAFTRQGRPRQASRSRQNQREAHFIKRLYQGQLPFPNHAEKQKQFEFVGS
APTRRTKRTRRPQPLT

Important features:
Signal peptide:
Amino acids 1-22

N-glycosylation site.
amino acids 9-13, 126-130 cAMP- and cGMP-dependent protein kinase phosphorylation site.
amino acids 60-64

Casein kinase II phosphorylation site.
amino acids 65-69

Tyrosine kinase phosphorylation site.
amino acids 39-48, 89-97

N-myristoylation site.
amino acids 69-75, 188-194

Amidation site.
amino acids 58-62

HBGF/FGF family signature.
amino acids 103-128

FIGURE 275

TATTTACCATATCAGATTCACATTCAGTCCTCAGCAAAATGAAGGGCTCCATTTTCACTCTGT
TTTTATTCTCTGTCCTATTTGCCATCTCAGAAGTGCGGAGCAAGGAGTCTGTGAGACTCTGTG
GGCTAGAATACATACGGACAGTCATCTATATCTGTGCTAGCTCCAGGTGGAGAAGGCATCTGG
AGGGGATCCCTCAAGCTCAGCAAGCTGAGACAGGAAACTCCTTCCAGCTCCCACATAAACGTG
AGTTTTCTGAGGAAAATCCAGCGCAAAACCTTCCGAAGGTGGATGCCTCAGGGGAAGACCGTC
TTTGGGGTGGACAGATGCCCACTGAAGAGCTTTGGAAGTCAAAGAAGCATTCAGTGATGTCAA
GACAAGATTTACAAACTTTGTGTTGCACTGATGGCTGTTCCATGACTGATTTGAGTGCTCTTT
GCTAAGACAAGAGCAAATACCCAATGGGTGGCAGAGCTTTATCACATGTTTAATTACAGTGTT
TTACTGCCTGGTAGAACACTAATATTGTGTTATTAAAATGATGGCTTTTGGGTAGGCAAAACT
TCTTTTCTAAAAGGTATAGCTGAGCGGTTGAAACCACAGTGATCTCTATTTTCTCCCTTTGCC
AAGGTTAATGAACTGTTCTTTTCAAATTCTACTAATGCTTTGAAATTTCAAATGCTGCGCAAA
ATTGCAATAAAAATGCTATAAA

FIGURE 276

MKGSIFTLFLFSVLFAISEVRSKESVRLCGLEYIRTVIYICASSRWRRHLEGIPQAQQAETGN
SFQLPHKREFSEENPAQNLPKVDASGEDRLWGGQMPTEELWKSKKHSVMSRQDLQTLCCTDGC
SMTDLSALC

Important features:

Signal sequence:

amino acids 1-18 cAMP- and cGMP-dependent protein kinase phosphorylation site:

amino acids 107-111

N-myristoylation sites:

amino acids 3-9,52-58,96-102,125-131

Insulin family signature:

amino acids 121-136

Insulin family proteins:

amino acids 28-46

FIGURE 277

```
GCAGCTGGTTACTGCATTTCTCCATGTGGCAGACAGAGCAAAGCCACAACGCTTTCTCTGCTGGATTAAAGACGG
CCCACAGACCAGAACTTCCACTATACTACTTAAAATTACATAGGTGGCTTGTCAAATTCAATTGATTAGTATTGT
AAAAGGAAAAGAAGTTCCTTCTTACAGCTTGGATTCAACGGTCCAAAACAAAAATGCAGCTGCCATTAAAGTCT
CAGATGAACAAACTTCTACACTGATTTTTAAAATCAAGAATAAGGGCAGCAAGTTTCTGGATTCACTGAATCAAC
AGACACAAAAAGCTGGCAATATAGCAACTATGAAGAGAAAAGCTACTAATAAAATTAACCCAACGCATAGAAGAC
TTTTTTTCTCTTCTAAAAACAACTAAGTAAAGACTTAAATTTAAACACATCATTTTACAACCTCATTTCAAAAT
GAAGACTTTTACCTGGACCCTAGGTGTGCTATTCTTCCTACTAGTGGACACTGGACATTGCAGAGGTGGACAATT
CAAAATTAAAAAAATAAACCAGAGAAGATACCCTCGTGCCACAGATGGTAAAGAGGAAGCAAAGAAATGTGCATA
CACATTCCTGGTACCTGAACAAAGAATAACAGGGCCAATCTGTGTCAACACCAAGGGGCAAGATGCAAGTACCAT
TAAAGACATGATCACCAGGATGGACCTTGAAAACCTGAAGGATGTGCTCTCCAGGCAGAAGCGGGAGATAGATGT
TCTGCAACTGGTGGTGGATGTAGATGGAAACATTGTGAATGAGGTAAAGCTGCTGAGAAAGGAAAGCCGTAACAT
GAACTCTCGTGTTACTCAACTCTATATGCAATTATTACATGAGATTATCCGTAAGAGGGATAATTCACTTGAACT
TTCCCAACTGGAAAACAAAATCCTCAATGTCACCACAGAAATGTTGAAGATGGCAACAAGATACAGGGAACTAGA
GGTGAAATACGCTTCCTTGACTGATCTTGTCAATAACCAATCTGTGATGATCACTTTGTTGGAAGAACAGTGCTT
GAGGATATTTTCCCGACAAGACACCCATGTGTCTCCCCCACTTGTCCAGGTGGTGCCACAACATATTCCTAACAG
CCAACAGTATACTCCTGGTCTGCTGGGAGGTAACGAGATTCAGAGGGATCCAGGTTATCCCAGAGATTTAATGCC
ACCACCTGATCTGGCAACTTCTCCCCACCAAAAGCCCTTTCAAGATACCACCGGTAACTTTCATCAATGAAGGACC
ATTCAAAGACTGTCAGCAAGCAAAAGAAGCTGGGCATTCGGTCAGTGGGATTTATATGATTAAACCTGAAAACAG
CAATGGACCAATGCAGTTATGGTGTGAAAACAGTTTGGACCCTGGGGGTTGGACTGTTATTCAGAAAAGAACAGA
CGGCTCTGTCAACTTCTTCAGAAATTGGGAAAATTATAAGAAAGGGTTTGGAAACATTGACGGAGAATACTGGCT
TGGACTGGAAAATATCTATATGCTTAGCAATCAAGATAATTACAAGTTATTGATTGAATTAGAAGACTGGAGTGA
TAAAAAAGTCTATGCAGAATACAGCAGCTTTCGTCTGGAACCTGAAAGTGAATTCTATAGACTGCGCCTGGGAAC
TTACCAGGGAAATGCAGGGGATTCTATGATGTGGCATAATGGTAAACAATTCACCACACTGGACAGAGATAAAGA
TATGTATGCAGGAAACTGCGCCCACTTTCATAAAGGAGGCTGGTGGTACAATGCCTGTGCACATTCTAACCTAAA
TGGAGTATGGTACAGAGGAGGCCATTACAGAAGCAAGCACCAAGATGGAATTTTCTGGGCCGAATACAGAGGCGG
GTCATACTCCTTAAGAGCAGTTCAGATGATGATCAAGCCTATTGACTGAAGAGAGACACTCGCCAATTTAAATGA
CACAGAACTTTGTACTTTTCAGCTCTTAAAAATGTAAATGTTACATGTATATTACTTGGCACAATTTATTTCTAC
ACAGAAAGTTTTTAAAATGAATTTTACCGTAACTATAAAAGGGAACCTATAAATGTAGTTTCATCTGTCGTCAAT
TACTGCAGAAAATTATGTGTATCCACAACCTAGTTATTTTAAAAATTATGTTGACTAAATACAAAGTTTGTTTTC
TAAAATGTAAATATTTGCCACAATGTAAAGCAAATCTTAGCTATATTTAAATCATAAATAACATGTTCAAGATA
CTTAACAATTTATTTAAAATCTAAGATTGCTCTAACGTCTAGTGAAAAAAATATTTTTAAATTTCAGCCAAATA
ATGCATTTTATTTTATAAAAATACAGACAGAAAATTAGGGAGAAACTTCTAGTTTTGCCAATAGAAAATGTTCTT
CCATTGAATAAAAGTTATTTCAAATTGAATTTGTGCCTTTCACACGTAATGATTAAATCTGAATTCTTAATAATA
TATCCTATGCTGATTTTCCCAAAACATGACCCATAGTATTAAATACATATCATTTTTAAAAATAAAAAAAAACCC
AAAAATAATGCATGCATAATTTAAATGGTCAATTTATAAAGACAAATCTATGAATGAATTTTTCAGTGTTATCTT
CATATGTATATGCTGAACACCAAAATCTCCAGAAATGCATTTTATGTAGTTCTAAAATCAGCAAAATATTGGTATT
ACAAAAATGCAGAATATTTAGTGTGCTACAGATCTGAATTATAGTTCTAATTTATTATTACTTTTTTTCTAATTT
ACTGATCTTACTACTACAAAGAAAAAAAAACCCAACCCATCTGCAATTCAAATCAGAAAGTTTGGACAGCTTTAC
AAGTATTAGTGCATGCTCAGAACAGGTGGGACTAAAACAAACTCAAGGAACTGTTGGCTGTTTTCCCGATACTGA
GAATTCAACAGCTCCAGAGCAGAAGCCACAGGGGCATAGCTTAGTCCAAACTGCTAATTTCATTTTACAGTGTAT
GTAACGCTTAGTCTCACAGTGTCTTTAACTCATCTTTGCAATCAACAACTTTACTAGTGACTTTCTGGAACAATT
TCCTTTCAGGAATACATATTCACTGCTTAGAGGTGACCTTGCCTTAATATATTTGTGAAGTTAAAATTTTAAAGA
TAGCTCATGAAACTTTTGCTTAAGCAAAAAGAAAACCTCGAATTGAAATGTGTGAGGCAAACTATGCATGGGAAT
AGCTTAATGTGAAGATAATCATTTGGACAACTCAAATCCATCAACATGACCAATGTTTTCATCTGCCACATCTC
AAAATAAAACTTCTGGTGAAACAAATTAAACAAAATATCCAAACCTCAAAAAAAA
```

FIGURE 278

MKTFTWTLGVLFFLLVDTGHCRGGQFKIKKINQRRYPRATDGKEEAKKCAYTFLVPEQRITGP
ICVNTKGQDASTIKDMITRMDLENLKDVLSRQKREIDVLQLVVDVDGNIVNEVKLLRKESRNM
NSRVTQLYMQLLHEIIRKRDNSLELSQLENKILNVTTEMLKMATRYRELEVKYASLTDLVNNQ
SVMITLLEEQCLRIFSRQDTHVSPPLVQVVPQHIPNSQQYTPGLLGGNEIQRDPGYPRDLMPP
PDLATSPTKSPFKIPPVTFINEGPFKDCQQAKEAGHSVSGIYMIKPENSNGPMQLWCENSLDP
GGWTVIQKRTDGSVNFFRNWENYKKGFGNIDGEYWLGLENIYMLSNQDNYKLLIELEDWSDKK
VYAEYSSFRLEPESEFYRLRLGTYQGNAGDSMMWHNGKQFTTLDRDKDMYAGNCAHFHKGGWW
YNACAHSNLNGVWYRGGHYRSKHQDGIFWAEYRGGSYSLRAVQMMIKPID

Important features:
Signal sequence:
Amino acids 1-23

N-glycosylation sites:
Amino acids 160-164;188-192 cAMP- and cGMP-dependent protein kinase phosphorylation site:
Amino acids 120-124

Tyrosine kinase phosphorylation sites:
Amino acids 173-180;387-396

N-myristoylation sites:
Amino acids 70-76;110-116;232-238,343-349;400-406;467-473;
475-487

Fibrinogen beta and gamma chains C-terminal domain signature:
Amino acids 440-453

FIGURE 279

```
CCCACGCGTCCGCGCAGTCGCGCAGTTCTGCCTCCGCCTGCCAGTCTCGCCCGCGATCCCGGC
CCGGGGCTGTGGCGTCGACTCCGACCCAGGCAGCCAGCAGCCCGCGCGGGAGCCGGACCGCCG
CCGGAGGAGCTCGGACGGCATGCTGAGCCCCCTCCTTTGCTGAAGCCCGAGTGCGGAGAAGCC
CGGGCAAACGCAGGCTAAGGAGACCAAAGCGGCGAAGTCGCGAGACAGCGGACAAGCAGCGGA
GGAGAAGGAGGAGGAGGCGAACCCAGAGAGGGGCAGCAAAAGAAGCGGTGGTGGTGGGCGTCG
TGGCCATGGCGGCGGCTATCGCCAGCTCGCTCATCCGTCAGAAGAGGCAAGCCCGCGAGCGCG
AGAAATCCAACGCCTGCAAGTGTGTCAGCAGCCCCAGCAAAGGCAAGACCAGCTGCGACAAAA
ACAAGTTAAATGTCTTTTCCCGGGTCAAACTCTTCGGCTCCAAGAAGAGGCGCAGAAGAAGAC
CAGAGCCTCAGCTTAAGGGTATAGTTACCAAGCTATACAGCCGACAAGGCTACCACTTGCAGC
TGCAGGCGGATGGAACCATTGATGGCACCAAAGATGAGGACAGCACTTACACTCTGTTTAACC
TCATCCCTGTGGGTCTGCGAGTGGTGGCTATCCAAGGAGTTCAAACCAAGCTGTACTTGGCAA
TGAACAGTGAGGGATACTTGTACACCTCGGAACTTTTCACACCTGAGTGCAAATTCAAAGAAT
CAGTGTTTGAAAATTATTATGTGACATATTCATCAATGATATACCGTCAGCAGCAGTCAGGCC
GAGGGTGGTATCTGGGTCTGAACAAAGAAGGAGAGATCATGAAAGGCAACCATGTGAAGAAGA
ACAAGCCTGCAGCTCATTTTCTGCCTAAACCACTGAAAGTGGCCATGTACAAGGAGCCATCAC
TGCACGATCTCACGGAGTTCTCCCGATCTGGAAGCGGGACCCCAACCAAGAGCAGAAGTGTCT
CTGGCGTGCTGAACGGAGGCAAATCCATGAGCCACAATGAATCAACGTAGCCAGTGAGGGCAA
AAGAAGGGCTCTGTAACAGAACCTTACCTCCAGGTGCTGTTGAATTCTTCTAGCAGTCCTTCA
CCCAAAAGTTCAAATTTGTCAGTGACATTTACCAAACAAACAGGCAGAGTTCACTATTCTATC
TGCCATTAGACCTTCTTATCATCCATACTAAAGC
```

FIGURE 280

MAAAIASSLIRQKRQAREREKSNACKCVSSPSKGKTSCDKNKLNVFSRVKLFGSKKRRRRRPE
PQLKGIVTKLYSRQGYHLQLQADGTIDGTKDEDSTYTLFNLIPVGLRVVAIQGVQTKLYLAMN
SEGYLYTSELFTPECKFKESVFENYYVTYSSMIYRQQQSGRGWYLGLNKEGEIMKGNHVKKNK
PAAHFLPKPLKVAMYKEPSLHDLTEFSRSGSGTPTKSRSVSGVLNGGKSMSHNEST

Important Features:
N-glycosylation site:
Amino acids 242-246

Glycosaminoglycan attachment sites:
Amino acids 165-169, 218-222

Tyrosine kinase phosphorylation site:
Amino acids 93-100

N-myristoylation sites:
Amino acids 87-93, 231-237

ATP/GTP-binding site motif A (P-loop):
Amino acids 231-239

HBGF/FGF family proteins:
Amino acids 78-94, 102-153

FIGURE 281

```
CCAGGATGGAGCTGGGGCCTGTATAGCCATATTATTGTTCTATGCTACTAGACATGGGGGGA
CTTGGTGAAAAAGGTATTATCCAGCCAGAGGGTCTGGGAGCCCTGTCTTACTGAACCTGGGCA
ACCTGGATATTCTGAGACATATTTTGGGGGGATTTCAGTGAAAAAAGTGGGGGATCCCCTCCA
TTTAGAGTGTAGCAAAGGAAAAAACACCAAGGTTGGGTTCCTTCCTGACATTGGCAGTGCCCC
AGTAGGGGTGGGATGAGCGAATATTCCCAAAGCTAAAGTCCCACACCCTGTAGATTACAAGAG
TGGATTTGGCAGGAGTGTGCCCCAAAATACAGTGGAAAGGTGCCTGAAGATATTTAAACCACG
TCTTGGAAATTTAGTGGGTCTTGGCTTTGGGATAGGTGAAGTGAGGACAGACACTGGAGAGGA
GGGAAAGGGGACGTTTTCAATAGGAGGCAAAACTCGAGGGTGGGATCCACTGAGGAGTACATA
GGCTGCTGGATCTGGTGGAGCCAGCACTGGGCCCACGGGTGGTAACTGGCTGCTGTGGAGGGG
GGTACGTGAGGGGGGGTCTGGGCTTATCCTCAGGTCCTGTGGGTGGGGCAGCGAGTCGGGG
CCTGAGCGTCAAGAGCATGCCCTAGTGAGCGGGCTCCTCTGGGGGAGCCCAGCGCGCTCCGGG
CGCCTGCCGGTTTGGGGGTGTCTCCTCCCGGGGCGCTATGGCGGCGCTGGCCAGTAGCCTGAT
CCGGCAGAAGCGGGAGGTCCGCGAGCCCGGGGGCAGCCGGCCGGTGTCGGCGCAGCGGCGCGT
GTGTCCCCGCGGCACCAAGTCCCTTTGCCAGAAGCAGCTCCTCATCCTGCTGTCCAAGGTGCG
ACTGTGCGGGGGGCGGCCCGCGCGGCCGGACCGCGGCCCGGAGCCTCAGCTCAAAGGCATCGT
CACCAAACTGTTCTGCCGCCAGGGTTTCTACCTCCAGGCGAATCCCGACGGAAGCATCCAGGG
CACCCCAGAGGATACCAGCTCCTTCACCCACTTCAACCTGATCCCTGTGGGCCTCCGTGTGGT
CACCATCCAGAGCGCCAAGCTGGGTCACTACATGGCCATGAATGCTGAGGGACTGCTCTACAG
TTCGCCGCATTTCACAGCTGAGTGTCGCTTTAAGGAGTGTGTCTTTGAGAATTACTACGTCCT
GTACGCCTCTGCTCTCTACCGCCAGCGTCGTTCTGGCCGGGCCTGGTACCTCGGCCTGGACAA
GGAGGGCCAGGTCATGAAGGGAAACCGAGTTAAGAAGACCAAGGCAGCTGCCCACTTTCTGCC
CAAGCTCCTGGAGGTGGCCATGTACCAGGAGCCTTCTCTCCACAGTGTCCCCGAGGCCTCCCC
TTCCAGTCCCCCTGCCCCCTGAAATGTAGTCCCTGGACTGGAGGTTCCCTGCACTCCCAGTGA
GCCAGCCACCACCACAACCTGT
```

FIGURE 282

MAALASSLIRQKREVREPGGSRPVSAQRRVCPRGTKSLCQKQLLILLSKVRLCGGRPARPDRG
PEPQLKGIVTKLFCRQGFYLQANPDGSIQGTPEDTSSFTHFNLIPVGLRVVTIQSAKLGHYMA
MNAEGLLYSSPHFTAECRFKECVFENYYVLYASALYRQRRSGRAWYLGLDKEGQVMKGNRVKK
TKAAAHFLPKLLEVAMYQEPSLHSVPEASPSSPPAP

Important features:

Tyrosine kinase phosphorylation site:

Amino acids 199-207

N-myristoylation sites:

Amino acids 54-60; 89-95; 131-137

HBGF/FGF family signature:

Amino acids 131-155

FIGURE 283

ATGGCCGCGGCCATCGCTAGCGGCTTGATCCGCCAGAAGCGGCAGGCGCGGGAGCAGCACTGG
GACCGGCCGTCTGCCAGCAGGAGGCGGAGCAGCCCCAGCAAGAACCGCGGGCTCTGCAACGGC
AACCTGGTGGATATCTTCTCCAAAGTGCGCATCTTCGGCCTCAAGAAGCGCAGGTTGCGGCGC
CAAGATCCCCAGCTCAAGGGTATAGTGACCAGGTTATATTGCAGGCAAGGCTACTACTTGCAA
ATGCACCCCGATGGAGCTCTCGATGGAACCAAGGATGACAGCACTAATTCTACACTCTTCAAC
CTCATACCAGTGGGACTACGTGTTGTTGCCATCCAGGGAGTGAAAACAGGGTTGTATATAGCC
ATGAATGGAGAAGGTTACCTCTACCCATCAGAACTTTTTACCCCTGAATGCAAGTTTAAAGAA
TCTGTTTTTGAAAATTATTATGTAATCTACTCATCCATGTTGTACAGACAACAGGAATCTGGT
AGAGCCTGGTTTTGGGATTAAATAAGGAAGGGCAAGCTATGAAAGGGAACAGAGTAAAGAAA
ACCAAACCAGCAGCTCATTTTCTACCCAAGCCATTGGAAGTTGCCATGTACCGAGAACCATCT
TTGCATGATGTTGGGGAAACGGTCCCGAAGCCTGGGGTGACGCCAAGTAAAAGCACAAGTGCG
TCTGCAATAATGAATGGAGGCAAACCAGTCAACAAGAGTAAGACAACATAG

FIGURE 284

MAAAIASGLIRQKRQAREQHWDRPSASRRRSSPSKNRGLCNGNLVDIFSKVRIFGLKKRRLRR
QDPQLKGIVTRLYCRQGYYLQMHPDGALDGTKDDSTNSTLFNLIPVGLRVVAIQGVKTGLYIA
MNGEGYLYPSELFTPECKFKESVFENYYVIYSSMLYRQQESGRAWFLGLNKEGQAMKGNRVKK
TKPAAHFLPKPLEVAMYREPSLHDVGETVPKPGVTPSKSTSASAIMNGGKPVNKSKTT

Important features:
N-glycosylation sites:
Amino acids 100-104, 242-246 cAMP- and cGMP-dependent protein kinase phosphorylation sites:
Amino acids 28-32, 29-33

Tyrosine kinase phosphorylation site:
Amino acids 199-207

N-myristoylation sites:
Amino acids 38-44, 89-95, 118-124, 122-128, 222-228

HBGF/FGF family proteins:
Amino acids 104-155, 171-198

FIGURE 285

```
CGGACGCGTGGGCGGACGCGTGGGCGGACGCGTGGGCGGACGCGTGGGCTGGTTCAGGTCCAGGTTTTGCTTTGA
TCCTTTTCAAAAACTGGAGACACAGAAGAGGGCTCTAGGAAAAAGTTTTGGATGGGATTATGTGGAAACTACCCT
GCGATTCTCTGCTGCCAGAGCAGGCTCGGCGCTTCCACCCCAGTGCAGCCTTCCCCTGGCGGTGGTGAAAGAGAC
TCGGGAGTCGCTGCTTCCAAAGTGCCCGCCGTGAGTGAGCTCTCACCCCAGTCAGCCAAATGAGCCTCTTCGGGC
TTCTCCTGCTGACATCTGCCCTGGCCGGCCAGAGACAGGGGACTCAGGCGGAATCCAACCTGAGTAGTAAATTCC
AGTTTTCCAGCAACAAGGAACAGAACGGAGTACAAGATCCTCAGCATGAGAGAATTATTACTGTGTCTACTAATG
GAAGTATTCACAGCCCAAGGTTTCCTCATACTTATCCAAGAAATACGGTCTTGGTATGGAGATTAGTAGCAGTAG
AGGAAAATGTATGGATACAACTTACGTTTGATGAAAGATTTGGGCTTGAAGACCCAGAAGATGACATATGCAAGT
ATGATTTTGTAGAAGTTGAGGAACCCAGTGATGGAACTATATTAGGGCGCTGGTGTGGTTCTGGTACTGTACCAG
GAAAACAGATTTCTAAAGGAAATCAAATTAGGATAAGATTTGTATCTGATGAATATTTTCCTTCTGAACCAGGGT
TCTGCATCCACTACAACATTGTCATGCCACAATTCACAGAAGCTGTGAGTCCTTCAGTGCTACCCCCTTCAGCTT
TGCCACTGGACCTGCTTAATAATGCTATAACTGCCTTTAGTACCTTGGAAGACCTTATTCGATATCTTGAACCAG
AGAGATGGCAGTTGGACTTAGAAGATCTATATAGGCCAACTTGGCAACTTCTTGGCAAGGCTTTTGTTTTTGGAA
GAAAATCCAGAGTGGTGGATCTGAACCTTCTAACAGAGGAGGTAAGATTATACAGCTGCACACCTCGTAACTTCT
CAGTGTCCATAAGGGAAGAACTAAAGAGAACCGATACCATTTTCTGGCCAGGTTGTCTCCTGGTTAAACGCTGTG
GTGGGAACTGTGCCTGTTGTCTCCACAATTGCAATGAATGTCAATGTGTCCCAAGCAAAGTTACTAAAAAATACC
ACGAGGTCCTTCAGTTGAGACCAAAGACCGGTGTCAGGGGATTGCACAAATCACTCACCGACGTGGCCCTGGAGC
ACCATGAGGAGTGTGACTGTGTGTGCAGAGGGAGCACAGGAGGATAGCCGCATCACCACCAGCAGCTCTTGCCCA
GAGCTGTGCAGTGCAGTGGCTGATTCTATTAGAGAACGTATGCGTTATCTCCATCCTTAATCTCAGTTGTTTGCT
TCAAGGACCTTTCATCTTCAGGATTTACAGTGCATTCTGAAAGAGGAGACATCAAACAGAATTAGGAGTTGTGCA
ACAGCTCTTTTGAGAGGAGGCCTAAAGGACAGGAGAAAAGGTCTTCAATCGTGGAAAGAAAATTAAATGTTGTAT
TAAATAGATCACCAGCTAGTTTCAGAGTTACCATGTACGTATTCCACTAGCTGGGTTCTGTATTTCAGTTCTTTC
GATACGGCTTAGGGTAATGTCAGTACAGGAAAAAAACTGTGCAAGTGAGCACCTGATTCCGTTGCCTTGCTTAAC
TCTAAAGCTCCATGTCCTGGGCCTAAAATCGTATAAAATCTGGATTTTTTTTTTTTTTGCTCATATTCACAT
ATGTAAACCAGAACATTCTATGTACTACAAACCTGGTTTTTAAAAAGGAACTATGTTGCTATGAATTAAACTTGT
GTCATGCTGATAGGACAGACTGGATTTTTCATATTTCTTATTAAAATTTCTGCCATTTAGAAGAAGAGAACTACA
TTCATGGTTTGGAAGAGATAAACCTGAAAGAAGAGTGGCCTTATCTTCACTTTATCGATAAGTCAGTTTATTTG
TTTCATTGTGTACATTTTTATATTCTCCTTTTGACATTATAACTGTTGGCTTTTCTAATCTTGTTAAATATATCT
ATTTTTACCAAAGGTATTTAATATTCTTTTTTATGACAACTTAGATCAACTATTTTTAGCTTGGTAAATTTTTCT
AAACACAATTGTTATAGCCAGAGGAACAAAGATGATATAAAATATTGTTGCTCTGACAAAAATACATGTATTTCA
TTCTCGTATGGTGCTAGAGTTAGATTAATCTGCATTTTAAAAAACTGAATTGGAATAGAATTGGTAAGTTGCAAA
GACTTTTTGAAAATAATTAAATTATCATATCTTCCATTCCTGTTATTGGAGATGAAAATAAAAAGCAACTTATGA
AAGTAGACATTCAGATCCAGCCATTACTAACCTATTCCTTTTTGGGGAAATCTGAGCCTAGCTCAGAAAAACAT
AAAGCACCTTGAAAAGACTTGGCAGCTTCCTGATAAAGCGTGCTGTGCTGTGCAGTAGGAACACATCCTATTTA
TTGTGATGTTGTGGTTTTATTATCTTAAACTCTGTTCCATACACTTGTATAAATACATGGATATTTTTATGTACA
GAAGTATGTCTCTTAACCAGTTCACTTATTGTACTCTGGCAATTTAAAAGAAAATCAGTAAAATATTTTGCTTGT
AAAATGCTTAATATNGTGCCTAGGTTATGTGGTGACTATTTGAATCAAAAATGTATTGAATCATCAAATAAAAGA
ATGTGGCTATTTTGGGGAGAAAATTAAAAAAAAAAAAAAAAAAAAAAGGTTTAGGGATAACAGGGTAATGCGGCC
```

FIGURE 286

MSLFGLLLLTSALAGQRQGTQAESNLSSKFQFSSNKEQNGVQDPQHERIITVSTNGSIHSPRF
PHTYPRNTVLVWRLVAVEENVWIQLTFDERFGLEDPEDDICKYDFVEVEEPSDGTILGRWCGS
GTVPGKQISKGNQIRIRFVSDEYFPSEPGFCIHYNIVMPQFTEAVSPSVLPPSALPLDLLNNA
ITAFSTLEDLIRYLEPERWQLDLEDLYRPTWQLLGKAFVFGRKSRVVDLNLLTEEVRLYSCTP
RNFSVSIREELKRTDTIFWPGCLLVKRCGGNCACCLHNCNECQCVPSKVTKKYHEVLQLRPKT
GVRGLHKSLTDVALEHHEECDCVCRGSTGG

Important features:

signal sequence:

Amino acids 1-14

N-glycosylation sites:

Amino acids 25-29;55-59;254-258

N-myristoylation sites:

Amino acids 15-21;117-123;127-133;281-287;282-288;319-325

Amidation site:

Amino acids 229-233

FIGURE 287

CAGCGCTGACTGCGCCGCGGAGAAAGCCAGTGGGAACCCAGACCCATAGGAGACCCGCGTCCC
CGCTCGGCCTGGCCAGGCCCCGCGCT<u>ATG</u>GAGTTCCTCTGGGCCCCTCTCTTGGGTCTGTGCT
GCAGTCTGGCCGCTGCTGATCGCCACACCGTCTTCTGGAACAGTTCAAATCCCAAGTTCCGGA
ATGAGGACTACACCATACATGTGCAGCTGAATGACTACGTGGACATCATCTGTCCGCACTATG
AAGATCACTCTGTGGCAGACGCTGCCATGGAGCAGTACATACTGTACCTGGTGGAGCATGAGG
AGTACCAGCTGTGCCAGCCCCAGTCCAAGGACCAAGTCCGCTGGCAGTGCAACCGGCCCAGTG
CCAAGCATGGCCCGGAGAAGCTGTCTGAGAAGTTCCAGCGCTTCACACCTTTCACCCTGGGCA
AGGAGTTCAAAGAAGGACACAGCTACTACTACATCTCCAAACCCATCCACCAGCATGAAGACC
GCTGCTTGAGGTTGAAGGTGACTGTCAGTGGCAAAATCACTCACAGTCCTCAGGCCCATGACA
ATCCACAGGAGAAGAGACTTGCAGCAGATGACCCAGAGGTGCGGGTTCTACATAGCATCGGTC
ACAGTGCTGCCCCACGCCTCTTCCCACTTGCCTGGACTGTGCTGCTCCTTCCACTTCTGCTGC
TGCAAACCCCG<u>TGA</u>AGGTGTGTGCCACACCTGGCCTTAAAGAGGGACAGGCTGAAGAGAGGGA
CAGGCACTCCAAACCTGTCTTGGGGCCACTTTCAGAGCCCCCAGCCCTGGGAACCACTCCCAC
CACAGGCATAAGCTATCACCTAGCAGCCTCAAAACGGGTCAATATTAAGGTTTTCAACCGGAA
GGAGGCCAACCAGCCCGACAGTGCCATCCCCACCTTCACCTCGGAGGGATGGAGAAAGAAGTG
GAGACAGTCCTTTCCCACCATTCCTGCCTTTAAGCCAAAGAAACAAGCTGTGCAGGCATGGTC
CCTTAAGGCACAGTGGGAGCTGAGCTGGAAGGGGCCACGTGGATGGGCAAAGCTTGTCAAAGA
TGCCCCCTTCAGGAGAGAGCCAGGATGCCCAGATGAACTGACTGAAGGAAAAGCAAGAAACAG
TTTCTTGCTTGGAAGCCAGGTACAGGAGAGGCAGCATGCTTGGGCTGACCCAGCATCTCCCAG
CAAGACCTCATCTGTGGAGCTGCCACAGAGAAGTTTGTAGCCAGGTACTGCATTCTCTCCCAT
CCTGGGGCAGCACTCCCCAGAGCTGTGCCAGCAGGGGGCTGTGCCAACCTGTTCTTAGAGTG
TAGCTGTAAGGGCAGTGCCCATGTGTACATTCTGCCTAGAGTGTAGCCTAAAGGGCAGGGCCC
ACGTGTATAGTATCTGTATATAAGTTGCTGTGTGTCTGTCCTGATTTCTACAACTGGAGTTTT
TTTATACAATGTTCTTTGTCTCAAAATAAAGCAATGTGTTTTTTCGG

FIGURE 288

MEFLWAPLLGLCCSLAAADRHTVFWNSSNPKFRNEDYTIHVQLNDYVDIICPHYEDHSADAAM
EQYILYLVEHEEYQLCQPQSKDQVRWQCNRPSAKHGPEKLSEKFQRFTPFTLGKEFKEGHSYY
YISKPIHQHEDRCLRLKVTVSGKITHSPQAHDNPQEKRLAADDPEVRVLHSIGHSAAPRLFPL
AWTVLLLPLLLLQTP

Important features:

Signal sequence:

Amino acids 1-17

N-glycosylation site:

Amino acids 26-30

Tyrosine kinase phosphorylation site:

Amino acids 118-127

N-myristoylation site:

Amino acids 10-16

FIGURE 289

CGGACGCGTGGGCGGACGCGTGGGCGGCCCACGGCGCCCGCGGGCTGGGGCGGTCGCTTCTTC
CTTCTCCGTGGCCTACGAGGGTCCCCAGCCTGGGTAAAG<u>ATG</u>GCCCCATGGCCCCGAAGGGC
CTAGTCCCAGCTGTGCTCTGGGGCCTCAGCCTCTTCCTCAACCTCCCAGGACCTATCTGGCTC
CAGCCCTCTCCACCTCCCCAGTCTTCTCCCCGCCTCAGCCCCATCCGTGTCATACCTGCCGG
GGACTGGTTGACAGCTTTAACAAGGGCCTGGAGAGAACCATCCGGGACAACTTTGGAGGTGGA
AACACTGCCTGGGAGGAAGAGAATTTGTCCAAATACAAAGACAGTGAGACCCGCCTGGTAGAG
GTGCTGGAGGGTGTGTGCAGCAAGTCAGACTTCGAGTGCCACCGCCTGCTGGAGCTGAGTGAG
GAGCTGGTGGAGAGCTGGTGGTTTCACAAGCAGCAGGAGGCCCCGGACCTCTTCCAGTGGCTG
TGCTCAGATTCCCTGAAGCTCTGCTGCCCCGCAGGCACCTTCGGGCCCTCCTGCCTTCCCTGT
CCTGGGGGAACAGAGAGGCCCTGCGGTGGCTACGGGCAGTGTGAAGGAGAAGGGACACGAGGG
GGCAGCGGGCACTGTGACTGCCAAGCCGGCTACGGGGGTGAGGCCTGTGGCCAGTGTGGCCTT
GGCTACTTTGAGGCAGAACGCAACGCCAGCCATCTGGTATGTTCGGCTTGTTTTGGCCCCTGT
GCCCGATGCTCAGGACCTGAGGAATCAAACTGTTTGCAATGCAAGAAGGGCTGGGCCCTGCAT
CACCTCAAGTGTGTAGACATTGATGAGTGTGGCACAGAGGGAGCCAACTGTGGAGCTGACCAA
TTCTGCGTGAACACTGAGGGCTCCTATGAGTGCCGAGACTGTGCCAAGGCCTGCCTAGGCTGC
ATGGGGGCAGGGCCAGGTCGCTGTAAGAAGTGTAGCCCTGGCTATCAGCAGGTGGGCTCCAAG
TGTCTCGATGTGGATGAGTGTGAGACAGAGGTGTGTCCGGGAGAGAACAAGCAGTGTGAAAAC
ACCGAGGGCGGTTATCGCTGCATCTGTGCCGAGGGCTACAAGCAGATGGAAGGCATCTGTGTG
AAGGAGCAGATCCCAGAGTCAGCAGGCTTCTTCTCAGAGATGACAGAAGACGAGTTGGTGGTG
CTGCAGCAGATGTTCTTTGGCATCATCATCTGTGCACTGGCCACGCTGGCTGCTAAGGGCGAC
TTGGTGTTCACCGCCATCTTCATTGGGGCTGTGGCGGCCATGACTGGCTACTGGTTGTCAGAG
CGCAGTGACCGTGTGCTGGAGGGCTTCATCAAGGGCAGA<u>TAA</u>TCGCGGCCACCACCTGTAGGA
CCTCCTCCCACCCACGCTGCCCCAGAGCTTGGGCTGCCCTCCTGCTGGACACTCAGGACAGC
TTGGTTTATTTTTGAGAGTGGGGTAAGCACCCTACCTGCCTTACAGAGCAGCCCAGGTACCC
AGGCCCGGGCAGACAAGGCCCCTGGGGTAAAAAGTAGCCCTGAAGGTGGATACCATGAGCTCT
TCACCTGGCGGGGACTGGCAGGCTTCACAATGTGTGAATTTCAAAAGTTTTTCCTTAATGGTG
GCTGCTAGAGCTTTGGCCCCTGCTTAGGATTAGGTGGTCCTCACAGGGGTGGGGCCATCACAG
CTCCCTCCTGCCAGCTGCATGCTGCCAGTTCCTGTTCTGTGTTCACCACATCCCCACACCCCA
TTGCCACTTATTTATTCATCTCAGGAAATAAAGAAGGTCTTGGAAAGTTAAAAAAAAAAAAA
AAAAAAAAAA

FIGURE 290

MAPWPPKGLVPAVLWGLSLFLNLPGPIWLQPSPPPQSSPPPQPHPCHTCRGLVDSFNKGLERT
IRDNFGGGNTAWEEENLSKYKDSETRLVEVLEGVCSKSDFECHRLLELSEELVESWWFHKQQE
APDLFQWLCSDSLKLCCPAGTFGPSCLPCPGGTERPCGGYGQCEGEGTRGGSGHCDCQAGYGG
EACGQCGLGYFEAERNASHLVCSACFGPCARCSGPEESNCLQCKKGWALHHLKCVDIDECGTE
GANCGADQFCVNTEGSYECRDCAKACLGCMGAGPGRCKKCSPGYQQVGSKCLDVDECETEVCP
GENKQCENTEGGYRCICAEGYKQMEGICVKEQIPESAGFFSEMTEDELVVLQQMFFGIIICAL
ATLAAKGDLVFTAIFIGAVAAMTGYWLSERSDRVLEGFIKGR

Important features:

Signal sequence:
Amino acids 1-29

Transmembrane domain:
Amino acids 342-392

N-glycosylation sites:
Amino acids 79-83;205-209 cAMP- and cGMP-dependent protein kinase phosphorylation site:
Amino acids 290-294

Aspartic acid and asparagine hydroxylation site:
Amino acids 321-333

EGF-like domain cysteine pattern signature:
Amino acids 181-193

FIGURE 291

CAGGTCCAACTGCACCTCGGTTCTATCGATTGAATTCCCCGGGGATCCTCTAGAGATCCCTCGACCTCGACCCAC
GCGTCCGAACACAGGTCCTTGTTGCTGCAGAGAAGCAGTTGTTTTGCTGGAAGGAGGGAGTGCGCGGGCTGCCCC
GGGCTCCTCCCTGCCGCCTCCTCTCAGTGGATGGTTCCAGGCACCCTGTCTGGGGCAGGGAGGGCACAGGCCTGC
ACATCGAAGGTGGGGTGGGACCAGGCTGCCCCTCGCCCCAGCATCCAAGTCCTCCCTTGGGCGCCGTGGCCCTG
CAGACTCTCAGGGCTAAGGTCCTCTGTTGCTTTTTGGTTCCACCTTAGAAGAGGCTCCGCTTGACTAAGAGTAGC
TTGAAGGAGGCACC<u>ATG</u>CAGGAGCTGCATCTGCTCTGGTGGGCGCTTCTCCTGGGCCTGGCTCAGGCCTGCCCTG
AGCCCTGCGACTGTGGGGAAAAGTATGGCTTCCAGATCGCCGACTGTGCCTACCGCGACCTAGAATCCGTGCCGC
CTGGCTTCCCGGCCAATGTGACTACACTGAGCCTGTCAGCCAACCGGCTGCCAGGCTTGCCGGAGGGTGCCTTCA
GGGAGGTGCCCCTGCTGCAGTCGCTGTGGCTGGCACACAATGAGATCCGCACGGTGGCCGCCGGAGCCCTGGCCT
CTCTGAGCCATCTCAAGAGCCTGGACCTCAGCCACAATCTCATCTCTGACTTTGCCTGGAGCGACCTGCACAACC
TCAGTGCCCTCCAATTGCTCAAGATGGACAGCAACGAGCTGACCTTCATCCCCCGCGACGCCTTCCGCAGCCTCC
GTGCTCTGCGCTCGCTGCAACTCAACCACAACCGCTTGCACACATTGGCCGAGGGCACCTTCACCCCGCTCACCG
CGCTGTCCCACCTGCAGATCAACGAGAACCCCTTCGACTGCACCTGCGGCATCGTGTGGCTCAAGACATGGGCCC
TGACCACGGCCGTGTCCATCCCGGAGCAGGACAACATCGCCTGCACCTCACCCCATGTGCTCAAGGGTACACCGC
TGAGCCGCCTGCCGCCACTGCCATGCTCGGCGCCCTCAGTGCAGCTCAGCTACCAACCCAGCCAGGATGGTGCCG
AGCTGCGGCCTGGTTTTGTGCTGGCACTGCACTGTGATGTGGACGGGCAGCCGGCCCCTCAGCTTCACTGGCACA
TCCAGATACCCAGTGGCATTGTGGAGATCACCAGCCCCAACGTGGGCACTGATGGGCGTGCCCTGCCTGGCACCC
CTGTGGCCAGCTCCCAGCCGCGCTTCCAGGCCTTTGCCAATGGCAGCCTGCTTATCCCCGACTTTGGCAAGCTGG
AGGAAGGCACCTACAGCTGCCTGGCCACCAATGAGCTGGGCAGTGCTGAGAGCTCAGTGGACGTGGCACTGGCCA
CGCCCGGTGAGGGTGGTGAGGACACACTGGGGCGCAGGTTCCATGGCAAAGCGGTTGAGGGAAAGGGCTGCTATA
CGGTTGACAACGAGGTGCAGCCATCAGGGCCGGAGGACAATGTGGTCATCATCTACCTCAGCCGTGCTGGGAACC
CTGAGGCTGCAGTCGCAGAAGGGGTCCCTGGGCAGCTGCCCCAGGCCTGCTCCTGCTGGGCCAAAGCCTCCTCC
TCTTCTTCTTCCTCACCTCCTTC<u>TAG</u>CCCCACCCAGGGCTTCCCTAACTCCTCCCCTTGCCCCTACCAATGCCCC
TTTAAGTGCTGCAGGGGTCTGGGGTTGGCAACTCCTGAGGCCTGCATGGGTGACTTCACATTTTCCTACCTCTCC
TTCTAATCTCTTCTAGAGCACCTGCTATCCCCAACTTCTAGACCTGCTCCAAACTAGTGACTAGGATAGAATTTG
ATCCCCTAACTCACTGTCTGCGGTGCTCATTGCTGCTAACAGCATTGCCTGTGCTCTCCTCTCAGGGCAGCATG
CTAACGGGGCGACGTCCTAATCCAACTGGGAGAAGCCTCAGTGGTGGAATTCCAGGCACTGTGACTGTCAAGCTG
GCAAGGGCCAGGATTGGGGGAATGGAGCTGGGGCTTAGCTGGGAGGTGGTCTGAAGCAGACAGGGAATGGGAGAG
GAGGATGGGAAGTAGACAGTGGCTGGTATGGCTCTGAGGCTCCCTGGGGCCTGCTCAAGCTCCTCCTGCTCCTTG
CTGTTTTCTGATGATTTGGGGGCTTGGGAGTCCCTTTGTCCTCATCTGAGACTGAAATGTGGGGATCCAGGATGG
CCTTCCTTCCTCTTACCCTTCCTCCCTCAGCCTGCAACCTCTATCCTGGAACCTGTCCTCCCTTTCTCCCCAACT
ATGCATCTGTTGTCTGCTCCTCTGCAAAGGCCAGCCAGCTTGGGAGCAGCAGAGAAATAAACAGCATTTCTGATG
CCAAAAAAAAAAAAAAAAAAGGGCGGCCGCGACTCTAGAGTCGACCT

FIGURE 292

MQELHLLWWALLLGLAQACPEPCDCGEKYGFQIADCAYRDLESVPPGFPANVTTLSLSANRLP
GLPEGAFREVPLLQSLWLAHNEIRTVAAGALASLSHLKSLDLSHNLISDFAWSDLHNLSALQL
LKMDSNELTFIPRDAFRSLRALRSLQLNHNRLHTLAEGTFTPLTALSHLQINENPFDCTCGIV
WLKTWALTTAVSIPEQDNIACTSPHVLKGTPLSRLPPLPCSAPSVQLSYQPSQDGAELRPGFV
LALHCDVDGQPAPQLHWHIQIPSGIVEITSPNVGTDGRALPGTPVASSQPRFQAFANGSLLIP
DFGKLEEGTYSCLATNELGSAESSVDVALATPGEGGEDTLGRRFHGKAVEGKGCYTVDNEVQP
SGPEDNVVIIYLSRAGNPEAAVAEGVPGQLPPGLLLLGQSLLLFFFLTSF

Important features:

Signal peptide:
amino acids 1-18

Transmembrane domain:
amino acids 403-418

N-glycosylation sites:
Amino acids 51-55,120-124,309-313

Tyrosine kinase phosphorylation site:
amino acids 319-326

N-myristoylation sites:
amino acids 14-20,64-70,92-98,218-224,294-300,323-329,334-340,
350-356,394-400

Amidation site:
amino acids 355-359

Leucine Rich Repeat:
amino acids 51-74,75-98, 99-122,123-146,147-170

Leucine rich repeat C-terminal domain:
amino acids 180-230

FIGURE 293

```
ACTTGGAGCAAGCGGCGGCGGCGGAGACAGAGGCAGAGGCAGAAGCTGGGGCTCCGTCCTCGCCTCCCACGAGCG
ATCCCCGAGGAGAGCCGCGGCCCTCGGCGAGGCGAAGAGGCCGACGAGGAAGACCCGGGTGGCTGCGCCCCTGCC
TCGCTTCCCAGGCGCCGGCGGCTGCAGCCTTGCCCCTCTTGCTCGCCTTGAAAATGGAAAAGATGCTCGCAGGCT
GCTTTCTGCTGATCCTCGGACAGATCGTCCTCCTCCCTGCCGAGGCCAGGGAGCGGTCACGTGGGAGGTCCATCT
CTAGGGGCAGACACGCTCGGACCCACCCGCAGACGGCCCTTCTGGAGAGTTCCTGTGAGAACAAGCGGGCAGACC
TGGTTTTCATCATTGACAGCTCTCGCAGTGTCAACACCCATGACTATGCAAAGGTCAAGGAGTTCATCGTGGACA
TCTTGCAATTCTTGGACATTGGTCCTGATGTCACCCGAGTGGGCCTGCTCCAATATGGCAGCACTGTCAAGAATG
AGTTCTCCCTCAAGACCTTCAAGAGGAAGTCCGAGGTGGAGCGTGCTGTCAAGAGGATGCGGCATCTGTCCACGG
GCACCATGACTGGGCTGGCCATCCAGTATGCCCTGAACATCGCATTCTCAGAAGCAGAGGGGCCCGGCCCCTGA
GGGAGAATGTGCCACGGGTCATAATGATCGTGACAGATGGGAGACCTCAGGACTCCGTGGCCGAGGTGGCTGCTA
AGGCACGGGACACGGGCATCCTAATCTTTGCCATTGGTGTGGGCCAGGTAGACTTCAACACCTTGAAGTCCATTG
GGAGTGAGCCCCATGAGGACCATGTCTTCCTTGTGGCCAATTTCAGCCAGATTGAGACGCTGACCTCCGTGTTCC
AGAAGAAGTTGTGCACGGCCCACATGTGCAGCACCCTGGAGCATAACTGTGCCCACTTCTGCATCAACATCCCTG
GCTCATACGTCTGCAGGTGCAAACAAGGCTACATTCTCAACTCGGATCAGACGACTTGCAGAATCCAGGATCTGT
GTGCCATGGAGGACCACAACTGTGAGCAGCTCTGTGTGAATGTGCCGGGCTCCTTCGTCTGCCAGTGCTACAGTG
GCTACGCCCTGGCTGAGGATGGGAAGAGGTGTGTGGCTGTGGACTACTGTGCCTCAGAAAACCACGGATGTGAAC
ATGAGTGTGTAAATGCTGATGGCTCCTACCTTTGCCAGTGCCATGAAGGATTTGCTCTTAACCCAGATGAAAAAA
CGTGCACAAGGATCAACTACTGTGCACTGAACAAACCGGGCTGTGAGCATGAGTGCGTCAACATGGAGGAGAGCT
ACTACTGCCGCTGCCACCGTGGCTACACTCTGGACCCCAATGGCAAAACCTGCAGCCGAGTGGACCACTGTGCAC
AGCAGGACCATGGCTGTGAGCAGCTGTGTCTGAACACGGAGGATTCCTTCGTCTGCCAGTGCTCAGAAGGCTTCC
TCATCAACGAGGACCTCAAGACCTGCTCCCGGGTGGATTACTGCCTGCTGAGTGACCATGGTTGTGAATACTCCT
GTGTCAACATGGACAGATCCTTTGCCTGTCAGTGTCCTGAGGGACACGTGCTCCGCAGCGATGGGAAGACGTGTG
CAAAATTGGACTCTTGTGCTCTGGGGGACCACGGTTGTGAACATTCGTGTGTAAGCAGTGAAGATTCGTTTGTGT
GCCAGTGCTTTGAAGGTTATATACTCCGTGAAGATGGAAAAACCTGCAGAAGGAAAGATGTCTGCCAAGCTATAG
ACCATGGCTGTGAACACATTTGTGTGAACAGTGACGACTCATACACGTGCGAGTGCTTGGAGGGATTCCGGCTCG
CTGAGGATGGGAAACGCTGCCGAAGGAAGGATGTCTGCAAATCAACCCACCATGGCTGCGAACACATTTGTGTTA
ATAATGGGAATTCCTACATCTGCAAATGCTCAGAGGGATTTGTTCTAGCTGAGGACGGAAGACGGTGCAAGAAAT
GCACTGAAGGCCCAATTGACCTGGTCTTTGTGATCGATGGATCCAAGAGTCTTGGAGAAGAGAATTTTGAGGTCG
TGAAGCAGTTTGTCACTGGAATTATAGATTCCTTGACAATTTCCCCCAAAGCCGCTCGAGTGGGGCTGCTCCAGT
ATTCCACACAGGTCCACACAGAGTTCACTCTGAGAAACTTCAACTCAGCCAAAGACATGAAAAAAGCCGTGGCCC
ACATGAAATACATGGGAAAGGGCTCTATGACTGGGCTGGCCCTGAAACACATGTTTGAGAGAAGTTTTACCCAAG
GAGAAGGGGCCAGGCCCCTTTCCACAAGGGTGCCCAGAGCAGCCATTGTGTTCACCGACGGACGGGCTCAGGATG
ACGTCTCCGAGTGGGCCAGTAAAGCCAAGGCCAATGGTATCACTATGTATGCTGTTGGGGTAGGAAAAGCCATTG
AGGAGGAACTACAAGAGATTGCCTCTGAGCCCACAAACAAGCATCTCTTCTATGCCGAAGACTTCAGCACAATGG
ATGAGATAAGTGAAAAACTCAAGAAAGGCATCTGTGAAGCTCTAGAAGACTCCGATGGAAGACAGGACTCTCCAG
CAGGGGAACTGCCAAAAACGGTCCAACAGCCAACAGAATCTGAGCCAGTCACCATAAATATCCAAGACCTACTTT
CCTGTTCTAATTTTGCAGTGCAACACAGATATCTGTTTGAAGAAGACAATCTTTTACGGTCTACACAAAAGCTTT
CCCATTCAACAAAACCTTCAGGAAGCCCTTTGGAAGAAAAACACGATCAATGCAAATGTGAAAACCTTATAATGT
TCCAGAACCTTGCAAACGAAGAAGTAAGAAAATTAACACAGCGCTTAGAAGAAATGACACAGAATGGAAGCCC
TGGAAAATCGCCTGAGATACAGATGAAGATTAGAAATCGCGACACATTTGTAGTCATTGTATCACGGATTACAAT
GAACGCAGTGCAGAGCCCCAAAGCTCAGGCTATTGTTAAATCAATAATGTTGTGAAGTAAAACAATCAGTACTGA
GAAACCTGGTTTGCCACAGAACAAAGACAAGAAGTATACACTAACTTGTATAAATTTATCTAGGAAAAAAATCCT
TCAGAATTCTAAGATGAATTTACCAGGTGAGAATGAATAAGCTATGCAAGGTATTTTGTAATATACTGTGGACAC
AACTTGCTTCTGCCTCATCCTGCCTTAGTGTGCAATCTCATTTGACTATACGATAAAGTTTGCACAGTCTTACTT
CTGTAGAACACTGGCCATAGGAAATGCTGTTTTTTTGTACTGGACTTTACCTTGATATATGTATATGGATGTATG
CATAAAATCATAGGACATATGTACTTGTGGAACAAGTTGGATTTTTTATACAATATTAAAATTCACCACTTCAG
```

FIGURE 294

```
MEKMLAGCFLLILGQIVLLPAEARERSRGRSISRGRHARTHPQTALLESSCENKRADLVFIID
SSRSVNTHDYAKVKEFIVDILQFLDIGPDVTRVGLLQYGSTVKNEFSLKTFKRKSEVERAVKR
MRHLSTGTMTGLAIQYALNIAFSEAEGARPLRENVPRVIMIVTDGRPQDSVAEVAAKARDTGI
LIFAIGVGQVDFNTLKSIGSEPHEDHVFLVANFSQIETLTSVFQKKLCTAHMCSTLEHNCAHF
CINIPGSYVCRCKQGYILNSDQTTCRIQDLCAMEDHNCEQLCVNVPGSFVCQCYSGYALAEDG
KRCVAVDYCASENHGCEHECVNADGSYLCQCHEGFALNPDEKTCTRINYCALNKPGCEHECVN
MEESYYCRCHRGYTLDPNGKTCSRVDHCAQQDHGCEQLCLNTEDSFVCQCSEGFLINEDLKTC
SRVDYCLLSDHGCEYSCVNMDRSFACQCPEGHVLRSDGKTCAKLDSCALGDHGCEHSCVSSED
SFVCQCFEGYILREDGKTCRRKDVCQAIDHGCEHICVNSDDSYTCECLEGFRLAEDGKRCRRK
DVCKSTHHGCEHICVNNGNSYICKCSEGFVLAEDGRRCKKCTEGPIDLVFVIDGSKSLGEENF
EVVKQFVTGIIDSLTISPKAARVGLLQYSTQVHTEFTLRNFNSAKDMKKAVAHMKYMGKGSMT
GLALKHMFERSFTQGEGARPLSTRVPRAAIVFTDGRAQDDVSEWASKAKANGITMYAVGVGKA
IEEELQEIASEPTNKHLFYAEDFSTMDEISEKLKKGICEALEDSDGRQDSPAGELPKTVQQPT
ESEPVTINIQDLLSCSNFAVQHRYLFEEDNLLRSTQKLSHSTKPSGSPLEEKHDQCKCENLIM
FQNLANEEVRKLTQRLEEMTQRMEALENRLRYR
```

Important features:
Signal sequence:
Amino acids 1-23

N-glycosylation site:
Amino acids 221-225 cAMP- and cGMP-dependent protein kinase phosphorylation sites:
Amino acids 115-119;606-610;892-896

N-myristoylation sites:
Amino acids 133-139;258-264;299-305;340-346;453-459;494-500;
639-645;690-694;
752-758;792-798

Amidation sites:
Amino acids 314-318;560-564;601-605

Aspartic acid and asparagine hydroxylation sites:
Amino acids 253-265;294-306;335-347;376-388;417-429;
458-470;540-552;581-593

FIGURE 295

```
GGCCGGAGCAGCACGGCCGCAGGACCTGGAGCTCCGGCTGCGTCTTCCCGCAGCGCTACCCGC
CATGCGCCTGCCGCGCCGGGCCGCGCTGGGGCTCCTGCCGCTTCTGCTGCTGCTGCCGCCCGC
GCCGGAGGCCGCCAAGAAGCCGACGCCCTGCCACCGGTGCCGGGGGCTGGTGGACAAGTTTAA
CCAGGGGATGGTGGACACCGCAAAGAAGAACTTTGGCGGCGGGAACACGGCTTGGGAGGAAAA
GACGCTGTCCAAGTACGAGTCCAGCGAGATTCGCCTGCTGGAGATCCTGGAGGGGCTGTGCGA
GAGCAGCGACTTCGAATGCAATCAGATGCTAGAGGCGCAGGAGGAGCACCTGGAGGCCTGGTG
GCTGCAGCTGAAGAGCGAATATCCTGACTTATTCGAGTGGTTTTGTGTGAAGACACTGAAAGT
GTGCTGCTCTCCAGGAACCTACGGTCCCGACTGTCTCGCATGCCAGGGCGGATCCCAGAGGCC
CTGCAGCGGGAATGGCCACTGCAGCGGAGATGGGAGCAGACAGGGCGACGGGTCCTGCCGGTG
CCACATGGGGTACCAGGGCCCGCTGTGCACTGACTGCATGGACGGCTACTTCAGCTCGCTCCG
GAACGAGACCCACAGCATCTGCACAGCCTGTGACGAGTCCTGCAAGACGTGCTCGGGCCTGAC
CAACAGAGACTGCGGCGAGTGTGAAGTGGGCTGGGTGCTGGACGAGGGCGCCTGTGTGGATGT
GGACGAGTGTGCGGCCGAGCCGCCTCCCTGCAGCGCTGCGCAGTTCTGTAAGAACGCCAACGG
CTCCTACACGTGCGAAGAGTGTGACTCCAGCTGTGTGGGCTGCACAGGGGAAGGCCCAGGAAA
CTGTAAAGAGTGTATCTCTGGCTACGCGAGGGAGCACGGACAGTGTGCAGATGTGGACGAGTG
CTCACTAGCAGAAAAAACCTGTGTGAGGAAAAACGAAAACTGCTACAATACTCCAGGGAGCTA
CGTCTGTGTGTGTCCTGACGGCTTCGAAGAAACGGAAGATGCCTGTGTGCCGCCGGCAGAGGC
TGAAGCCACAGAAGGAGAAAGCCCGACACAGCTGCCCTCCCGCGAAGACCTGTAATGTGCCGG
ACTTACCCTTTAAATTATTCAGAAGGATGTCCCGTGGAAAATGTGGCCCTGAGGATGCCGTCT
CCTGCAGTGGACAGCGGCGGGGAGAGGCTGCCTGCTCTCTAACGGTTGATTCTCATTTGTCCC
TTAAACAGCTGCATTTCTTGGTTGTTCTTAAACAGACTTGTATATTTTGATACAGTTCTTTGT
AATAAAATTGACCATTGTAGGTAATCAGGAGGAAAAAAAAA
```

FIGURE 296

MRLPRRAALGLLPLLLLLPPAPEAAKKPTPCHRCRGLVDKFNQGMVDTAKKNFGGGNTAWEEK
TLSKYESSEIRLLEILEGLCESSDFECNQMLEAQEEHLEAWWLQLKSEYPDLFEWFCVKTLKV
CCSPGTYGPDCLACQGGSQRPCSGNGHCSGDGSRQGDGSCRCHMGYQGPLCTDCMDGYFSSLR
NETHSICTACDESCKTCSGLTNRDCGECEVGWVLDEGACVDVDECAAEPPPCSAAQFCKNANG
SYTCEECDSSCVGCTGEGPGNCKECISGYAREHGQCADVDECSLAEKTCVRKNENCYNTPGSY
VCVCPDGFEETEDACVPPAEAEATEGESPTQLPSREDL

Important features:

Signal peptide:
Amino acids 1-24

N-glycosylation sites:
Amino acids 190-194;251-255

Glycosaminoglycan attachment sites:
Amino acids 149-153;155-159 cAMP- and cGMP-dependent protein kinase phosphorylation site:
Amino acids 26-30

Tyrosine kinase phosphorylation site:
Amino acids 303-310

N-myristoylation sites:
Amino acids  44-50;54-60;55-61;81-87;150-156;158-164;164-170;
252-258;313-319

Aspartic acid and asparagine hydroxylation site:
Amino acids 308-320

EGF-like domain cysteine pattern signature:
Amino acids 166-178

Leucine zipper pattern:
Amino acids 94-116

FIGURE 297

```
GACATCGGAGGTGGGCTAGCACTGAAACTGCTTTTCAAGACGAGGAAGAGGAGGAGAAAGAGAAAGAAGAGGAAG
ATGTTGGGCAACATTTATTTAACATGCTCCACAGCCCGGACCCTGGCATCATGCTGCTATTCCTGCAAATACTGA
AGAAGCATGGGATTTAAATATTTTACTTCTAAATAAATGAATTACTCAATCTCCTATGACCATCTATACATACTC
CACCTTCAAAAAGTACATCAATATTATATCATTAAGGAAATAGTAACCTTCTCTTCTCCAATATGCATGACATTT
TTGGACAATGCAATTGTGGCACTGGCACTTATTTCAGTGAAGAAAAACTTTGTGGTTCTATGGCATTCATCATTT
GACAAATGCAAGCATCTTCCTTATCAATCAGCTCCTATTGAACTTACTAGCACTGACTGTGGAATCCTTAAGGGC
CCATTACATTTCTGAAGAAGAAAGCTAAGATGAAGGACATGCCACTCCGAATTCATGTGCTACTTGGCCTAGCTA
TCACTACACTAGTACAAGCTGTAGATAAAAAAGTGGATTGTCCACGGTTATGTACGTGTGAAATCAGGCCTTGGT
TTACACCCAGATCCATTTATATGGAAGCATCTACAGTGGATTGTAATGATTTAGGTCTTTTAACTTTCCCAGCCA
GATTGCCAGCTAACACACAGATTCTTCTCCTACAGACTAACAATATTGCAAAAATTGAATACTCCACAGACTTTC
CAGTAAACCTTACTGGCCTGGATTTATCTCAAAACAATTTATCTTCAGTCACCAATATTAATGTAAAAAAGATGC
CTCAGCTCCTTTCTGTGTACCTAGAGGAAAACAAACTTACTGAACTGCCTGAAAAATGTCTGTCCGAACTGAGCA
ACTTACAAGAACTCTATATTAATCACAACTTGCTTTCTACAATTTCACCTGGAGCCTTTATTGGCCTACATAATC
TTCTTCGACTTCATCTCAATTCAAATAGATTGCAGATGATCAACAGTAAGTGGTTTGATGCTCTTCCAAATCTAG
AGATTCTGATGATTGGGGAAAATCCAATTATCAGAATCAAAGACATGAACTTTAAGCCTCTTATCAATCTTCGCA
GCCTGGTTATAGCTGGTATAAACCTCACAGAAATACCAGATAACGCCTTGGTTGGACTGGAAAACTTAGAAAGCA
TCTCTTTTTACGATAACAGGCTTATTAAAGTACCCCATGTTGCTCTTCAAAAAGTTGTAAATCTCAAATTTTTGG
ATCTAAATAAAAATCCTATTAATAGAATACGAAGGGGTGATTTTAGCAATATGCTACACTTAAAAGAGTTGGGGA
TAAATAATATGCCTGAGCTGATTTCCATCGATAGTCTTGCTGTGGATAACCTGCCAGATTTAAGAAAAATAGAAG
CTACTAACAACCCTAGATTGTCTTACATTCACCCCAATGCATTTTTCAGACTCCCCAAGCTGGAATCACTCATGC
TGAACAGCAATGCTCTCAGTGCCCTGTACCATGGTACCATTGAGTCTCTGCCAAACCTCAAGGAAATCAGCATAC
ACAGTAACCCCATCAGGTGTGACTGTGTCATCCGTTGGATGAACATGAACAAAACCAACATTCGATTCATGGAGC
CAGATTCACTGTTTTGCGTGGACCCACCTGAATTCCAAGGTCAGAATGTTCGGCAAGTGCATTTCAGGGACATGA
TGGAAATTTGTCTCCCTCTTATAGCTCCTGAGAGCTTTCCTTCTAATCTAAATGTAGAAGCTGGGAGCTATGTTT
CCTTTCACTGTAGAGCTACTGCAGAACCACAGCCTGAAATCTACTGGATAACACCTTCTGGTCAAAAACTCTTGC
CTAATACCCTGACAGACAAGTTCTATGTCCATTCTGAGGGAACACTAGATATAAATGGCGTAACTCCCAAAGAAG
GGGGTTTATATACTTGTATAGCAACTAACCTAGTTGGCGCTGACTTGAAGTCTGTTATGATCAAAGTGGATGGAT
CTTTTCCACAAGATAACAATGGCTCTTTGAATATTAAAATAAGAGATATTCAGGCCAATTCAGTTTGGTGTCCT
GGAAAGCAAGTTCTAAAATTCTCAAATCTAGTGTTAAATGGACAGCCTTTGTCAAGACTGAAAATTCTCATGCTG
CGCAAAGTGCTCGAATACCATCTGATGTCAAGGTATATAATCTTACTCATCTGAATCCATCAACTGAGTATAAAA
TTTGTATTGATATTCCCACCATCTATCAGAAAACAGAAAAAAATGTGTAAATGTCACCACCAAAGGTTTGCACC
CTGATCAAAAGAGTATGAAAAGAATAATACCACAACACTTATGGCCTGTCTTGGAGGCCTTCTGGGGATTATTG
GTGTGATATGTCTTATCAGCTGCCTCTCTCCAGAAATGAACTGTGATGGTGGACACAGCTATGTGAGGAATTACT
TACAGAAACCAACCTTTGCATTAGGTGAGCTTTATCCTCCTCTGATAAATCTCTGGGAAGCAGGAAAAGAAAAAA
GTACATCACTGAAAGTAAAAGCAACTGTTATAGGTTTACCAACAAATATGTCCTAAAAACCACCAAGGAAACCTA
CTCCAAAAATGAAC
```

FIGURE 298

MKDMPLRIHVLLGLAITTLVQAVDKKVDCPRLCTCEIRPWFTPRSIYMEASTVDCNDLGLLTF
PARLPANTQILLLQTNNIAKIEYSTDFPVNLTGLDLSQNNLSSVTNINVKKMPQLLSVYLEEN
KLTELPEKCLSELSNLQELYINHNLLSTISPGAFIGLHNLLRLHLNSNRLQMINSKWFDALPN
LEILMIGENPIIRIKDMNFKPLINLRSLVIAGINLTEIPDNALVGLENLESISFYDNRLIKVP
HVALQKVVNLKFLDLNKNPINRIRRGDFSNMLHLKELGINNMPELISIDSLAVDNLPDLRKIE
ATNNPRLSYIHPNAFFRLPKLESLMLNSNALSALYHGTIESLPNLKEISIHSNPIRCDCVIRW
MNMNKTNIRFMEPDSLFCVDPPEFQGQNVRQVHFRDMMEICLPLIAPESFPSNLNVEAGSYVS
FHCRATAEPQPEIYWITPSGQKLLPNTLTDKFYVHSEGTLDINGVTPKEGGLYTCIATNLVGA
DLKSVMIKVDGSFPQDNNGSLNIKIRDIQANSVLVSWKASSKILKSSVKWTAFVKTENSHAAQ
SARIPSDVKVYNLTHLNPSTEYKICIDIPTIYQKNRKKCVNVTTKGLHPDQKEYEKNNTTTLM
ACLGGLLGIIGVICLISCLSPEMNCDGGHSYVRNYLQKPTFALGELYPPLINLWEAGKEKSTS
LKVKATVIGLPTNMS

Important features:

Signal sequence:
amino acids 1-22

Transmembrane domain:
amino acids 633-650

N-glycosylation site.
amino acids 93-97, 103-107, 223-227, 382-386, 522-526, 579-583,
608-612, 624-628, 625-629

Casein kinase II phosphorylation site.
amino acids 51-55, 95-99, 242-246, 468-472, 487-491

Tyrosine kinase phosphorylation site.
amino acids 570-579

N-myristoylation site.
amino acids 13-19, 96-102, 158-164, 221-227, 352-358, 437-443,
491-497, 492-498, 634-640, 702-708

Cell attachment sequence.
amino acids 277-280

FIGURE 299

GCTGTGGGAACCTCTCCACGCGCACGAACTCAGCCAACGATTTCTGATAGATTTTTGGGAGTT
TGACCAGAGATGCAAGGGGTGAAGGAGCGCTTCCTACCGTTAGGGAACTCTGGGGACAGAGCG
CCCCGGCCGCCTGATGGCCGAGGCAGGGTGCGACCCAGGACCCAGGACGGCGTCGGGAACCAT
ACCATGGCCCGGATCCCCAAGACCCTAAAGTTCGTCGTCGTCATCGTCGCGGTCCTGCTGCCA
GTCCTAGCTTACTCTGCCACCACTGCCCGGCAGGAGGAAGTTCCCCAGCAGACAGTGGCCCCA
CAGCAACAGAGGCACAGCTTCAAGGGGGAGGAGTGTCCAGCAGGATCTCATAGATCAGAACAT
ACTGGAGCCTGTAACCCGTGCACAGAGGGTGTGGATTACACCAACGCTTCCAACAATGAACCT
TCTTGCTTCCCATGTACAGTTTGTAAATCAGATCAAAAACATAAAAGTTCCTGCACCATGACC
AGAGACACAGTGTGTCAGTGTAAAGAAGGCACCTTCCGGAATGAAAACTCCCCAGAGATGTGC
CGGAAGTGTAGCAGGTGCCCTAGTGGGGAAGTCCAAGTCAGTAATTGTACGTCCTGGGATGAT
ATCCAGTGTGTTGAAGAATTTGGTGCCAATGCCACTGTGGAAACCCCAGCTGCTGAAGAGACA
ATGAACACCAGCCCGGGGACTCCTGCCCCAGCTGCTGAAGAGACAATGAACACCAGCCCAGGG
ACTCCTGCCCCAGCTGCTGAAGAGACAATGACCACCAGCCCGGGGACTCCTGCCCCAGCTGCT
GAAGAGACAATGACCACCAGCCCGGGGACTCCTGCCCCAGCTGCTGAAGAGACAATGACCACC
AGCCCGGGGACTCCTGCCTCTTCTCATTACCTCTCATGCACCATCGTAGGGATCATAGTTCTA
ATTGTGCTTCTGATTGTGTTTGTTTGAAAGACTTCACTGTGGAAGAAATTCCTTCCTTACCTG
AAAGGTTCAGGTAGGCGCTGGCTGAGGGCGGGGGCGCTGGACACTCTCTGCCCTGCCTCCCT
CTGCTGTGTTCCCACAGACAGAAACGCCTGC

FIGURE 300

MARIPKTLKFVVVIVAVLLPVLAYSATTARQEEVPQQTVAPQQQRHSFKGEECPAGSHRSEHT
GACNPCTEGVDYTNASNNEPSCFPCTVCKSDQKHKSSCTMTRDTVCQCKEGTFRNENSPEMCR
KCSRCPSGEVQVSNCTSWDDIQCVEEFGANATVETPAAEETMNTSPGTPAPAAEETMNTSPGT
PAPAAEETMTTSPGTPAPAAEETMTTSPGTPAPAAEETMTTSPGTPASSHYLSCTIVGIIVLI
VLLIVFV

Important features:

Signal peptide:

Amino acids 1-29

Transmembrane domain:

Amino acids 240-259

N-glycosylation site:

Amino acids 77-81;140-144;156-160 cAMP- and cGMP-dependent protein kinase phosphorylation site:

Amino acids 126-130

N-myristoylation sites:

Amino acids 56-62;72-78;114-120;154-160;233-239

FIGURE 301

CACAAGCATCTTAATTTGAATCCACAAAGTTTCATGTAATGAAAAGAAATACATAATTTTAAT
TCAACCCGAGTGTTTTCCAAGAAGATTGTATTTGCTTAAATTGCTACAGTAATTCAAGAGACA
GCCCTGTCTGGACACAGAGTTACTGTGGATTTTAAGAGACTCAGTTAAAGAATTTAGGAATT
TCTGATTCATTTAAAGGATTTACAAATTCATCAACCCCTGAAAACTAAAGCAAATTGAACAGG
AAAAAAAAAAGAAG<u>ATG</u>GGTTTTTTAAGTCCAATATATGTTATTTTCTTCTTTTTTGGAGTC
AAAGTACATTGCCAATATGAAACTTATCAGTGGGATGAAGACTATGACCAAGAGCCAGATGAT
GATTACCAAACAGGATTCCCATTTCGTCAAATGTAGACTACGGAGTTCCTTTTCATCAGTAT
ACTTTAGGCTGTGTCAGTGAATGCTTCTGTCCAACTAACTTTCCATCATCAATGTACTGTGAT
AATCGCAAACTCAAGACTATCCCAAATATTCCGATGCACATTCAGCAACTCTACCTTCAGTTC
AATGAAATTGAGGCTGTGACTGCAAATTCATTCATCAATGCAACTCATCTTAAAGAAATTAAC
CTCAGCCACAACAAAATTAAATCTCAAAAGATTGATTATGGTGTGTTTGCTAAGCTTCCAAAT
CTACTACAACTTCATCTAGAGCATAATAATTTAGAAGAATTTCCATTTCCTCTTCCTAAATCT
CTGGAAAGACTCCTTCTTGGTTACAATGAAATCTCCAAACTGCAGACAAATGCTATGGATGGG
CTAGTAAACTTGACCATGCTTGATCTCTGTTATAATTATCTTCATGATTCTCTGCTAAAAGAC
AAAATCTTTGCCAAAATGGAAAAACTAATGCAGCTCAACCTCTGCAGTAACAGATTAGAATCA
ATGCCTCCTGGTTTGCCTTCTTCACTTATGTATCTGTCTTTAGAAAATAATTCAATTTCTTCT
ATACCCGAAAAATACTTCGACAAACTTCCAAAACTTCATACTCTAAGAATGTCACACAACAAA
CTACAAGACATCCCATATAATATTTTTAATCTTCCCAACATTGTAGAACTCAGTGTTGGACAC
AACAAATTGAAGCAAGCATTCTATATTCCAAGAAATTTGGAACACCTATACCTACAAAATAAT
GAAATAGAAAGATGAATCTTACAGTGATGTGTCCTTCTATTGACCCACTACATTACCACCAT
TTAACATACATTCGTGTGGACCAAAATAAACTAAAAGAACCAATAAGCTCATACATCTTCTTC
TGCTTCCCTCATATACACACTATTTATTATGGTGAACAACGAAGCACTAATGGTCAAACAATA
CAACTAAAGACACAAGTTTTCAGGAGATTTCCAGATGATGATGATGAAAGTGAAGATCACGAT
GATCCTGACAATGCTCATGAGAGCCCAGAACAAGAAGGAGCAGAAGGGCACTTTGACCTTCAT
TATTATGAAAATCAAGAA<u>TAG</u>CAAGAAACTATATAGGTATACACTTACGACTTCACAAAACCTA
TACTTAATATAGTAAATCTAAGTAAACATGTATTACTCAAAGTAATATATTTAGAATTATGTA
TTAGTATAAGATCAGAATTGAATTTAAGTTGTTGGTGACATCTGCATCATTTCATAGGATTAG
AACTTACTCAAAATAATGTAAATCTTTAAAAATATAAATTAGAATGACAAGTGGGAATCATAA
ATTAAACGTTAATGGTTTCTTATGCTCTTTTTAAATATAGAAATATCATGTTAAAGAAAAAA
AAAAAAA

FIGURE 302

MGFLSPIYVIFFFFGVKVHCQYETYQWDEDYDQEPDDDYQTGFPFRQNVDYGVPFHQYTLGCV
SECFCPTNFPSSMYCDNRKLKTIPNIPMHIQQLYLQFNEIEAVTANSFINATHLKEINLSHNK
IKSQKIDYGVFAKLPNLLQLHLEHNNLEEFPFPLPKSLERLLLGYNEISKLQTNAMDGLVNLT
MLDLCYNYLHDSLLKDKIFAKMEKLMQLNLCSNRLESMPPGLPSSLMYLSLENNSISSIPEKY
FDKLPKLHTLRMSHNKLQDIPYNIFNLPNIVELSVGHNKLKQAFYIPRNLEHLYLQNNEIEKM
NLTVMCPSIDPLHYHHLTYIRVDQNKLKEPISSYIFFCFPHIHTIYYGEQRSTNGQTIQLKTQ
VFRRFPDDDDESEDHDDPDNAHESPEQEGAEGHFDLHYYENQE

Important feastures:
N-glycosylation sites:
Amino acids 113-117;121-125; 187-191;242-246;316-320

Tyrosine kinase phosphorylation sites:
Amino acids 268-275;300-307

N-myristoylation site:
Amino acids 230-236

Leucine zipper patterns:
Amino acids 146-168;217-239

FIGURE 303

GCCCGGGACTGGCGCAAGGTGCCCAAGCAAGGAAAGAAATAATGAAGAGACACATGTTAGC
TGCAGCCTTTTGAAACACGCAAGAAGGAAATCAATAGTGTGGACAGGGCTGGAACCTTTACCA
CGCTTGTTGGAGTAGATGAGGAATGGGCTCGTGATTATGCTGACATTCCAGC<u>ATG</u>AATCTGGT
AGACCTGTGGTTAACCCGTTCCCTCTCCATGTGTCTCCTCCTACAAAGTTTTGTTCTTATGAT
ACTGTGCTTTCATTCTGCCAGTATGTGTCCCAAGGGCTGTCTTTGTTCTTCCTCTGGGGGTTT
AAATGTCACCTGTAGCAATGCAAATCTCAAGGAAATACCTAGAGATCTTCCTCCTGAAACAGT
CTTACTGTATCTGGACTCCAATCAGATCACATCTATTCCCAATGAAATTTTTAAGGACCTCCA
TCAACTGAGAGTTCTCAACCTGTCCAAAAATGGCATTGAGTTTATCGATGAGCATGCCTTCAA
AGGAGTAGCTGAAACCTTGCAGACTCTGGACTTGTCCGACAATCGGATTCAAAGTGTGCACAA
AAATGCCTTCAATAACCTGAAGGCCAGGGCCAGAATTGCCAACAACCCCTGGCACTGCGACTG
TACTCTACAGCAAGTTCTGAGGAGCATGGCGTCCAATCATGAGACAGCCCACAACGTGATCTG
TAAAACGTCCGTGTTGGATGAACATGCTGGCAGACCATTCCTAATGCTGCCAACGACGCTGA
CCTTTGTAACCTCCCTAAAAAAACTACCGATTATGCCATGCTGGTCACCATGTTTGGCTGGTT
CACTATGGTGATCTCATATGTGGTATATTATGTGAGGCAAAATCAGGAGGATGCCCGGAGACA
CCTCGAATACTTGAAATCCCTGCCAAGCAGGCAGAAGAAAGCAGATGAACCTGATGATATTAG
CACTGTGGTA<u>TAG</u>TGTCCAAACTGACTGTCATTGAGAAAGAAAGAAAGTAGTTTGCGATTGCA
GTAGAAATAAGTGGTTTACTTCTCCCATCCATTGTAAACATTTGAAACTTTGTATTTCAGTTT
TTTTTGAATTATGCCACTGCTGAACTTTTAACAAACACTACAACATAAATAATTTGAGTTTAG
GTGATCCACCCCTTAATTGTACCCCGATGGTATATTTCTGAGTAAGCTACTATCTGAACATT
AGTTAGATCCATCTCACTATTTAATAATGAATTTATTTTTTAATTTAAAAGCAAATAAAAG
CTTAACTTTGAACCATGGGAAAAAAAAAAAAAAAAAAAAAAACA

FIGURE 304

MNLVDLWLTRSLSMCLLLQSFVLMILCFHSASMCPKGCLCSSSGGLNVTCSNANLKEIPRDLP
PETVLLYLDSNQITSIPNEIFKDLHQLRVLNLSKNGIEFIDEHAFKGVAETLQTLDLSDNRIQ
SVHKNAFNNLKARARIANNPWHCDCTLQQVLRSMASNHETAHNVICKTSVLDEHAGRPFLNAA
NDADLCNLPKKTTDYAMLVTMFGWFTMVISYVVYYVRQNQEDARRHLEYLKSLPSRQKKADEP
DDISTVV

Important features:

Signal sequence:
Amino acids 1-33

Transmembrane domain:
Amino acids 204-219

N-glycosylation sites:
Amino acids 47-51;94-98 cAMP- and cGMP-dependent protein kinase phosphorylation site:
Amino acids 199-203

Casein kinase II phosphorylation site.
amino acids 162-166, 175-179

N-myristoylation sites:
Amino acids 37-43;45-51;110-116

FIGURE 305

```
CGCCACCACTGCGGCCACCGCCAATGAAACGCCTCCCGCTCCTAGTGGTTTTTTCCACTTTGTTGAATTGTTCCT
ATACTCAAAATTGCACCAAGACACCTTGTCTCCCAAATGCAAAATGTGAAATACGCAATGGAATTGAAGCCTGCT
ATTGCAACATGGGATTTTCAGGAAATGGTGTCACAATTTGTGAAGATGATAATGAATGTGGAAATTTAACTCAGT
CCTGTGGCGAAAATGCTAATTGCACTAACACAGAAGGAAGTTATTATTGTATGTGTGTACCTGGCTTCAGATCCA
GCAGTAACCAAGACAGGTTTATCACTAATGATGGAACCGTCTGTATAGAAAATGTGAATGCAAACTGCCATTTAG
ATAATGTCTGTATAGCTGCAAATATTAATAAAACTTTAACAAAAATCAGATCCATAAAAGAACCTGTGGCTTTGC
TACAAGAAGTCTATAGAAATTCTGTGACAGATCTTTCACCAACAGATATAATTACATATATAGAAATATTAGCTG
AATCATCTTCATTACTAGGTTACAAGAACAACACTATCTCAGCCAAGGACACCCTTTCTAACTCAACTCTTACTG
AATTTGTAAAAACCGTGAATAATTTTGTTCAAAGGGATACATTTGTAGTTTGGGACAAGTTATCTGTGAATCATA
GGAGAACACATCTTACAAAACTCATGCACACTGTTGAACAAGCTACTTTAAGGATATCCCAGAGCTTCCAAAAGA
CCACAGAGTTTGATACAAATTCAACGGATATAGCTCTCAAAGTTTTCTTTTTTGATTCATATAACATGAAACATA
TTCATCCTCATATGAATATGGATGGAGACTACATAAATATATTTCCAAAGAGAAAAGCTGCATATGATTCAAATG
GCAATGTTGCAGTTGCATTTTTATATTATAAGAGTATTGGTCCTTTGCTTTCATCATCTGACAACTTCTTATTGA
AACCTCAAAATTATGATAATTCTGAAGAGGAGGAAAGAGTCATATCTTCAGTAATTTCAGTCTCAATGAGCTCAA
ACCCACCCACATTATATGAACTTGAAAAAATAACATTTACATTAAGTCATCGAAAGGTCACAGATAGGTATAGGA
GTCTATGTGCATTTTGGAATTACTCACCTGATACCATGAATGGCAGCTGGTCTTCAGAGGGCTGTGAGCTGACAT
ACTCAAATGAGACCCACACCTCATGCCGCTGTAATCACCTGACACATTTTGCAATTTTGATGTCCTCTGGTCCTT
CCATTGGTATTAAAGATTATAATATTCTTACAAGGATCACTCAACTAGGAATAATTATTTCACTGATTTGTCTTG
CCATATGCATTTTTACCTTCTGGTTCTTCAGTGAAATTCAAAGCACCAGGACAACAATTCACAAAAATCTTTGCT
GTAGCCTATTTCTTGCTGAACTTGTTTTTCTTGTTGGGATCAATACAAATACTAATAAGCTCTTCTGTTCAATCA
TTGCCGGACTGCTACACTACTTCTTTTTAGCTGCTTTTGCATGGATGTGCATTGAAGGCATACATCTCTATCTCA
TTGTTGTGGGTGTCATCTACAACAAGGGATTTTTGCACAAGAATTTTTATATCTTTGGCTATCTAAGCCCAGCCG
TGGTAGTTGGATTTTCGGCAGCACTAGGATACAGATATTATGGCACAACCAAAGTATGTTGGCTTAGCACCGAAA
ACAACTTTATTTGGAGTTTTATAGGACCAGCATGCCTAATCATTCTTGTTAATCTCTTGGCTTTTGGAGTCATCA
TATACAAAGTTTTTCGTCACACTGCAGGGTTGAAACCAGAAGTTAGTTGCTTTGAGAACATAAGGTCTTGTGCAA
GAGGAGCCCTCGCTCTTCTGTTCCTTCTCGGCACCACCTGGATCTTTGGGGTTCTCCATGTTGTGCACGCATCAG
TGGTTACAGCTTACCTCTTCACAGTCAGCAATGCTTTCCAGGGGATGTTCATTTTTTTATTCCTGTGTGTTTTAT
CTAGAAAGATTCAAGAAGAATATTACAGATTGTTCAAAAATGTCCCCTGTTGTTTTGGATGTTTAAGGTAAACAT
AGAGAATGGTGGATAATTACAACTGCACAAAAATAAAAATTCCAAGCTGTGGATGACCAATGTATAAAAATGACT
CATCAAATTATCCAATTATTAACTACTAGACAAAAAGTATTTTAAATCAGTTTTTCTGTTTATGCTATAGGAACT
GTAGATAATAAGGTAAAATTATGTATCATATAGATATACTATGTTTTTCTATGTGAAATAGTTCTGTCAAAAATA
GTATTGCAGATATTTGGAAAGTAATTGGTTTCTCAGGAGTGATATCACTGCACCCAAGGAAAGATTTTCTTTCTA
ACACGAGAAGTATATGAATGTCCTGAAGGAAACCACTGGCTTGATATTTCTGTGACTCGTGTTGCCTTTGAAACT
AGTCCCCTACCACCTCGGTAATGAGCTCCATTACAGAAAGTGGAACATAAGAGAATGAAGGGGCAGAATATCAAA
CAGTGAAAAGGGAATGATAAGATGTATTTTGAATGAACTGTTTTTTCTGTAGACTAGCTGAGAAATTGTTGACAT
AAAATAAAGAATTGAAGAAACACATTTTACCATTTTGTGAATTGTTCTGAACTTAAATGTCCACTAAAACAACTT
AGACTTCTGTTTGCTAAATCTGTTTCTTTTTCTAATATTCTAAAAAAAAAAAAAAAGGTTTACCTCCACAAATTGA
AAAAAAAAAAAAAAAAAAAAAAAAAAAAAAAAAAAAAAAAAAAAA
```

FIGURE 306

MKRLPLLVVFSTLLNCSYTQNCTKTPCLPNAKCEIRNGIEACYCNMGFSGNGVTICEDDNECGNLTQSCGENANC
TNTEGSYYCMCVPGFRSSSNQDRFITNDGTVCIENVNANCHLDNVCIAANINKTLTKIRSIKEPVALLQEVYRNS
VTDLSPTDIITYIEILAESSSLLGYKNNTISAKDTLSNSTLTEFVKTVNNFVQRDTFVVWDKLSVNHRRTHLTKL
MHTVEQATLRISQSFQKTTEFDTNSTDIALKVFFFDSYNMKHIHPHMNMDGDYINIFPKRKAAYDSNGNVAVAFL
YYKSIGPLLSSSDNFLLKPQNYDNSEEEERVISSVISVSMSSNPPTLYELEKITFTLSHRKVTDRYRSLCAFWNY
SPDTMNGSWSSEGCELTYSNETHTSCRCNHLTHFAILMSSGPSIGIKDYNILTRITQLGIIISLICLAICIFTFW
FFSEIQSTRTTIHKNLCCSLFLAELVFLVGINTNTNKLFCSIIAGLLHYFFLAAFAWMCIEGIHLYLIVVGVIYN
KGFLHKNFYIFGYLSPAVVVGFSAALGYRYYGTTKVCWLSTENNFIWSFIGPACLIILVNLLAFGVIIYKVFRHT
AGLKPEVSCFENIRSCARGALALLFLLGTTWIFGVLHVVHASVVTAYLFTVSNAFQGMFIFLFLCVLSRKIQEEY
YRLFKNVPCCFGCLR

Important features:
Signal peptide:
Amino acids 1-19

Transmembrane domain:
Amino acids 431-450;494-515;573-594;619-636;646-664

N-glycosylation sites:
Amino acids 15-19;21-25;64-68;74-78;127-131;177-181;
188-192;249-253;381-385;395-399

Glycosaminoglycan attachment site:
Amino acids 49-53 cAMP- and cGMP-dependent protein kinase phosphorylation site:
Amino acids 360-364

Tyrosine kinase phosphorylation sites:
Amino acids 36-44;670-677

N-myristoylation sites:
Amino acids 38-44;50-56;52-58;80-86;382-388;388-394;
434-440;480-486;521-527

Aspartic acid and asparagine hydroxylation site:
Amino acids 75-87

FIGURE 307

```
CCAGGCCGGGAGGCGACGCGCCCAGCCGTCTAAACGGGAACAGCCCTGGCTGAGGGAGCTGCAGCGCAGCAGAGT
ATCTGACGGCGCCAGGTTGCGTAGGTGCGGCACGAGGAGTTTTCCCGGCAGCGAGGAGGTCCTGAGCAGCATGGC
CCGGAGGAGCGCCTTCCCTGCCGCCGCGCTCTGGCTCTGGAGCATCCTCCTGTGCCTGCTGGCACTGCGGGCGGA
GGCCGGGCCGCCGCAGGAGGAGAGCCTGTACCTATGGATCGATGCTCACCAGGCAAGAGTACTCATAGGATTTGA
AGAAGATATCCTGATTGTTTCAGAGGGGAAAATGGCACCTTTTACACATGATTTCAGAAAAGCGCAACAGAGAAT
GCCAGCTATTCCTGTCAATATCCATTCCATGAATTTTACCTGGCAAGCTGCAGGGCAGGCAGAATACTTCTATGA
ATTCCTGTCCTTGCGCTCCCTGGATAAAGGCATCATGGCAGATCCAACCGTCAATGTCCCTCTGCTGGGAACAGT
GCCTCACAAGGCATCAGTTGTTCAAGTTGGTTTCCCATGTCTTGGAAAACAGGATGGGGTGGCAGCATTTGAAGT
GGATGTGATTGTTATGAATTCTGAAGGCAACACCATTCTCCAAACACCTCAAAATGCTATCTTCTTTAAAACATG
TCAACAAGCTGAGTGCCCAGGCGGGTGCCGAAATGGAGGCTTTTGTAATGAAAGACGCATCTGCGAGTGTCCTGA
TGGGTTCCACGGACCTCACTGTGAGAAAGCCCTTTGTACCCCACGATGTATGAATGGTGGACTTTGTGTGACTCC
TGGTTTCTGCATCTGCCCACCTGGATTCTATGGAGTGAACTGTGACAAAGCAAACTGCTCAACCACCTGCTTTAA
TGGAGGGACCTGTTTCTACCCTGGAAAATGTATTTGCCCTCCAGGACTAGAGGGAGAGCAGTGTGAAATCAGCAA
ATGCCCACAACCCTGTCGAAATGGAGGTAAATGCATTGGTAAAAGCAAATGTAAGTGTTCCAAAGGTTACCAGGG
AGACCTCTGTTCAAAGCCTGTCTGCGAGCCTGGCTGTGGTGCACATGGAACCTGCCATGAACCCAACAAATGCCA
ATGTCAAGAAGGTTGGCATGGAAGACACTGCAATAAAAGGTACGAAGCCAGCCTCATACATGCCCTGAGGCCAGC
AGGCGCCCAGCTCAGGCAGCACACGCCTTCACTTAAAAAGGCCGAGGAGCGGCGGGATCCACCTGAATCCAATTA
CATCTGGTGAACTCCGACATCTGAAACGTTTTAAGTTACACCAAGTTCATAGCCTTTGTTAACCTTTCATGTGTT
GAATGTTCAAATAATGTTCATTACACTTAAGAATACTGGCCTGAATTTTATTAGCTTCATTATAAATCACTGAGC
TGATATTTACTCTTCCTTTTAAGTTTTCTAAGTACGTCTGTAGCATGATGGTATAGATTTTCTTGTTTCAGTGCT
TTGGGACAGATTTTATATTATGTCAATTGATCAGGTTAAAATTTTCAGTGTGTAGTTGGCAGATATTTTCAAAAT
TACAATGCATTTATGGTGTCTGGGGGCAGGGGAACATCAGAAAGGTTAAATTGGGCAAAAATGCGTAAGTCACAA
GAATTTGGATGGTGCAGTTAATGTTGAAGTTACAGCATTTCAGATTTTATTGTCAGATATTTAGATGTTTGTTAC
ATTTTTAAAAATTGCTCTTAATTTTTAAACTCTCAATACAATATATTTTGACCTTACCATTATTCCAGAGATTCA
GTATTAAAAAAAAAAAAATTACACTGTGGTAGTGGCATTTAAACAATATAATATATTCTAAACACAATGAAATAG
GGAATATAATGTATGAACTTTTTGCATTGGCTTGAAGCAATATAATATATTGTAAACAAAACACAGCTCTTACCT
AATAAACATTTTATACTGTTTGTATGTATAAAATAAAGGTGCTGCTTTAGTTTTTTGGAAAAAAAAAAAAAAAAA
AAAAAAAA
```

FIGURE 308

MARRSAFPAAALWLWSILLCLLALRAEAGPPQEESLYLWIDAHQARVLIGFEEDILIVSEGKM
APFTHDFRKAQQRMPAIPVNIHSMNFTWQAAGQAEYFYEFLSLRSLDKGIMADPTVNVPLLGT
VPHKASVVQVGFPCLGKQDGVAAFEVDVIVMNSEGNTILQTPQNAIFFKTCQQAECPGGCRNG
GFCNERRICECPDGFHGPHCEKALCTPRCMNGGLCVTPGFCICPPGFYGVNCDKANCSTTCFN
GGTCFYPGKCICPPGLEGEQCEISKCPQPCRNGGKCIGKSKCKCSKGYQGDLCSKPVCEPGCG
AHGTCHEPNKCQCQEGWHGRHCNKRYEASLIHALRPAGAQLRQHTPSLKKAEERRDPPESNYIW

Important features:

Signal sequence:
Amino acids 1-28

N-glycosylation sites:
Amino acids 88-92;245-249

Tyrosine kinase phosphorylation site:
Amino acids 370-378

N-myristoylation sites:
Amino acids 184-190;185-191;189-195;315-321

ATP/GTP-binding site motif A (P-loop):
Amino acids 285-293

EGF-like domain cysteine pattern signatures:
Amino acids 198-210;230-242;262-274;294-306;326-338

FIGURE 309

CCCACGCGTCCGGTCTCGCTCGCTCGCGCAGCGGCGGCAGCAGAGGTCGCGCACAGATGCGGG
TTAGACTGGCGGGGGGAGGAGGCGGAGGAGGGAAGGAAGCTGCATGCATGAGACCCACAGACT
CTTGCAAGCTGGATGCCCTCTGTGGATGAAAG<u>ATG</u>TATCATGGAATGAACCCGAGCAATGGAG
ATGGATTTCTAGAGCAGCAGCAGCAGCAGCAACCTCAGTCCCCCAGAGACTCTTGGCCG
TGATCCTGTGGTTTCAGCTGGCGCTGTGCTTCGGCCCTGCACAGCTCACGGGCGGGTTCGATG
ACCTTCAAGTGTGTGCTGACCCCGGCATTCCCGAGAATGGCTTCAGGACCCCCAGCGGAGGGG
TTTTCTTTGAAGGCTCTGTAGCCCGATTTCACTGCCAAGACGGATTCAAGCTGAAGGGCGCTA
CAAAGAGACTGTGTTTGAAGCATTTTAATGGAACCCTAGGCTGGATCCCAAGTGATAATTCCA
TCTGTGTGCAAGAAGATTGCCGTATCCCTCAAATCGAAGATGCTGAGATTCATAACAAGACAT
ATAGACATGGAGAGAAGCTAATCATCACTTGTCATGAAGGATTCAAGATCCGGTACCCCGACC
TACACAATATGGTTTCATTATGTCGCGATGATGGAACGTGGAATAATCTGCCCATCTGTCAAG
GCTGCCTGAGACCTCTAGCCTCTTCTAATGGCTATGTAAACATCTCTGAGCTCCAGACCTCCT
TCCCGGTGGGGACTGTGATCTCCTATCGCTGCTTTCCCGGATTTAAACTTGATGGGTCTGCGT
ATCTTGAGTGCTTACAAAACCTTATCTGGTCGTCCAGCCCACCCCGGTGCCTTGCTCTGGAAG
CCCAAGTCTGTCCACTACCTCCAATGGTGAGTCACGGAGATTTCGTCTGCCACCCGCGGCCTT
GTGAGCGCTACAACCACGGAACTGTGGTGGAGTTTTACTGCGATCCTGGCTACAGCCTCACCA
GCGACTACAAGTACATCACCTGCCAGTATGGAGAGTGGTTTCCTTCTTATCAAGTCTACTGCA
TCAAATCAGAGCAAACGTGGCCCAGCACCCATGAGACCCTCCTGACCACGTGGAAGATTGTGG
CGTTCACGGCAACCAGTGTGCTGCTGGTGCTGCTGCTCGTCATCCTGGCCAGGATGTTCCAGA
CCAAGTTCAAGGCCCACTTTCCCCCAGGGGGCCTCCCCGGAGTTCCAGCAGTGACCCTGACT
TTGTGGTGGTAGACGGCGTGCCCGTCATGCTCCCGTCCTATGACGAAGCTGTGAGTGGCGGCT
TGAGTGCCTTAGGCCCCGGGTACATGGCCTCTGTGGGCCAGGGCTGCCCCTTACCCGTGGACG
ACCAGAGCCCCCCAGCATACCCCGGCTCAGGGGACACGGACACAGGCCCAGGGGAGTCAGAAA
CCTGTGACAGCGTCTCAGGCTCTTCTGAGCTGCTCCAAAGTCTGTATTCACCTCCCAGGTGCC
AAGAGAGCACCCACCCTGCTTCGGACAACCCTGACATAATTGCCAGCACGGCAGAGGAGGTGG
CATCCACCAGCCCAGGCATCCATCATGCCCACTGGGTGTTGTTCCTAAGAAAC<u>TGA</u>TTGATTA
AAAAATTTCCCAAAGTGTCCTGAAGTGTCTCTTCAAATACATGTTGATCTGTGGAGTTGATTC
CTTTCCTTCTCTTGGTTTTAGACAAATGTAAACAAAGCTCTGATCCTTAAAATTGCTATGCTG
ATAGAGTGGTGAGGGCTGGAAGCTTGATCAAGTCCTGTTTCTTCTTGACACAGACTGATTAAA
AATTAAAAGNAAAAAA

FIGURE 310

MYHGMNPSNGDGFLEQQQQQQQPQSPQRLLAVILWFQLALCFGPAQLTGGFDDLQVCADPGIP
ENGFRTPSGGVFFEGSVARFHCQDGFKLKGATKRLCLKHFNGTLGWIPSDNSICVQEDCRIPQ
IEDAEIHNKTYRHGEKLIITCHEGFKIRYPDLHNMVSLCRDDGTWNNLPICQGCLRPLASSNG
YVNISELQTSFPVGTVISYRCFPGFKLDGSAYLECLQNLIWSSSPPRCLALEAQVCPLPPMVS
HGDFVCHPRPCERYNHGTVVEFYCDPGYSLTSDYKYITCQYGEWFPSYQVYCIKSEQTWPSTH
ETLLTTWKIVAFTATSVLLVLLLVILARMFQTKFKAHFPPRGPPRSSSSDPDFVVVDGVPVML
PSYDEAVSGGLSALGPGYMASVGQGCPLPVDDQSPPAYPGSGDTDTGPGESETCDSVSGSSEL
LQSLYSPPRCQESTHPASDNPDIIASTAEEVASTSPGIHHAHWVLFLRN

Important features:
Signal sequence:
amino acids 1-41

Transmembrane domain:
amino acids 325-344

N-glycosylation site.
amino acids 104-108, 134-138, 192-196

Casein kinase II phosphorylation site.
amino acids 8-12, 146-150, 252-256, 270-274, 313-317, 362-366, 364-368, 380-384, 467-471, 468-472

N-myristoylation site.
amino acids 4-10, 61-67, 169-175, 203-209, 387-393, 418-424, 478-484

Prokaryotic membrane lipoprotein lipid attachment site.
amino acids 394-405

FIGURE 311

CAGCGCGTGGCCGGCGCCGCTGTGGGGACAGCATGAGCGGCGGTTGGATGGCGCAGGTTGGAG
CGTGGCGAACAGGGGCTCTGGGCCTGGCGCTGCTGCTGCTCGGCCTCGGACTAGGCCTGG
AGGCCGCCGCGAGCCCGCTTTCCACCCCGACCTCTGCCCAGGCCGCAGGCCCCAGCTCAGGCT
CGTGCCCACCCACCAAGTTCCAGTGCCGCACCAGTGGCTTATGCGTGCCCCTCACCTGGCGCT
GCGACAGGGACTTGGACTGCAGCGATGGCAGCGATGAGGAGGAGTGCAGGATTGAGCCATGTA
CCCAGAAAGGGCAATGCCCACCGCCCCTGGCCTCCCCTGCCCCTGCACCGGCGTCAGTGACT
GCTCTGGGGGAACTGACAAGAAACTGCGCAACTGCAGCCGCCTGGCCTGCCTAGCAGGCGAGC
TCCGTTGCACGCTGAGCGATGACTGCATTCCACTCACGTGGCGCTGCGACGGCCACCCAGACT
GTCCCGACTCCAGCGACGAGCTCGGCTGTGGAACCAATGAGATCCTCCCGGAAGGGGATGCCA
CAACCATGGGGCCCCCTGTGACCCTGGAGAGTGTCACCTCTCTCAGGAATGCCACAACCATGG
GGCCCCCTGTGACCCTGGAGAGTGTCCCCTCTGTCGGGAATGCCACATCCTCCTCTGCCGGAG
ACCAGTCTGGAAGCCCAACTGCCTATGGGGTTATTGCAGCTGCTGCGGTGCTCAGTGCAAGCC
TGGTCACCGCCACCCTCCTCCTTTTGTCCTGGCTCCGAGCCCAGGAGCGCCTCCGCCCACTGG
GGTTACTGGTGGCCATGAAGGAGTCCCTGCTGCTGTCAGAACAGAAGACCTCGCTGCCCTGAG
GACAAGCACTTGCCACCACCGTCACTCAGCCCTGGGCGTAGCCGGACAGGAGGAGAGCAGTGA
TGCGGATGGGTACCCGGGCACACCAGCCCTCAGAGACCTGAGTTCTTCTGGCCACGTGGAACC
TCGAACCCGAGCTCCTGCAGAAGTGGCCCTGGAGATTGAGGGTCCCTGGACACTCCCTATGGA
GATCCGGGGAGCTAGGATGGGGAACCTGCCACAGCCAGAACTGAGGGGCTGGCCCCAGGCAGC
TCCCAGGGGGTAGAACGGCCCTGTGCTTAAGACACTCCCTGCTGCCCCGTCTGAGGGTGGCGA
TTAAAGTTGCTTC

FIGURE 312

MSGGWMAQVGAWRTGALGLALLLLLGLGLGLEAAASPLSTPTSAQAAGPSSGSCPPTKFQCRT
SGLCVPLTWRCDRDLDCSDGSDEEECRIEPCTQKGQCPPPPGLPCPCTGVSDCSGGTDKKLRN
CSRLACLAGELRCTLSDDCIPLTWRCDGHPDCPDSSDELGCGTNEILPEGDATTMGPPVTLES
VTSLRNATTMGPPVTLESVPSVGNATSSSAGDQSGSPTAYGVIAAAAVLSASLVTATLLLLSW
LRAQERLRPLGLLVAMKESLLLSEQKTSLP

Important features:
Signal sequence:
Amino acids 1-30

Transmembrane domain:
Amino acids 231-248

N-glycosylation sites:
Amino acids 126-130;195-199;213-217

Casein kinase II phosphorylation site.
amino acids 84-88, 140-144, 161-165, 218-222

N-myristoylation sites:
Amino acids 3-9;10-16;26-32;30-36;112-118;166-172;212-218;
224-230;230-236;263-269

Prokaryotic membrane lipoprotein lipid attachment site:
Amino acids 44-55

Leucine zipper pattern:
Amino acids 17-39

FIGURE 313

```
CGGACGCGTGGGCGTCCGGCGGTCGCAGAGCCAGGAGGCGGAGGCGCGCGGGCCAGCCTGGGCCCCAGCCCACAC
CTTCACCAGGGCCCAGGAGCCACCATGTGGCGATGTCCACTGGGGCTACTGCTGTTGCTGCCGCTGGCTGGCCAC
TTGGCTCTGGGTGCCCAGCAGGGTCGTGGGCGCCGGGAGCTAGCACCGGGTCTGCACCTGCGGGGCATCCGGGAC
GCGGGAGGCCGGTACTGCCAGGAGCAGGACCTGTGCTGCCGCGGCCGTGCCGACGACTGTGCCCTGCCCTACCTG
GGCGCCATCTGTTACTGTGACCTCTTCTGCAACCGCACGGTCTCCGACTGCTGCCCTGACTTCTGGGACTTCTGC
CTCGGCGTGCCACCCCCTTTTCCCCCGATCCAAGGATGTATGCATGGAGGTCGTATCTATCCAGTCTTGGGAACG
TACTGGGACAACTGTAACCGTTGCACCTGCCAGGAGAACAGGCAGTGGCATGGTGGATCCAGACATGATCAAAGC
CATCAACCAGGGCAACTATGGCTGGCAGGCTGGGAACCACAGCGCCTTCTGGGGCATGACCCTGGATGAGGGCAT
TCGCTACCGCCTGGGCACCATCCGCCCATCTTCCTCGGTCATGAACATGCATGAAATTTATACAGTGCTGAACCC
AGGGGAGGTGCTTCCCACAGCCTTCGAGGCCTCTGAGAAGTGGCCCAACCTGATTCATGAGCCTCTTGACCAAGG
CAACTGTGCAGGCTCCTGGGCCTTCTCCACAGCAGCTGTGGCATCCGATCGTGTCTCAATCCATTCTCTGGGACA
CATGACGCCTGTCCTGTCGCCCAGAACCTGCTGTCTTGTGACACCCACCAGCAGCAGGGCTGCCGCGGTGGGCG
TCTCGATGGTGCCTGGTGGTTCCTGCGTCGCCGAGGGGTGGTGTCTGACCACTGCTACCCCTTCTCGGGCCGTGA
ACGAGACGAGGCTGGCCCTGCGCCCCCTGTATGATGCACAGCCGAGCCATGGGTCGGGGCAAGCGCCAGGCCAC
TGCCCACTGCCCCAACAGCTATGTTAATAACAATGACATCTACCAGGTCACTCCTGTCTACCGCCTCGGCTCCAA
CGACAAGGAGATCATGAAGGAGCTGATGGAGAATGGCCCTGTCCAAGCCCTCATGGAGGTGCATGAGGACTTCTT
CCTATACAAGGGAGGCATCTACAGCCACACGCCAGTGAGCCTTGGGAGGCCAGAGAGATACCGCCGGCATGGGAC
CCACTCAGTCAAGATCACAGGATGGGAGAGGAGACGCTGCCAGATGGAAGGACGCTCAAATACTGGACTGCGGC
CAACTCCTGGGGCCCAGCCTGGGGCGAGAGGGGCCACTTCCGCATCGTGCGCGGCGTCAATGAGTGCGACATCGA
GAGCTTCGTGCTGGGCGTCTGGGGCCGCGTGGGCATGGAGGACATGGGTCATCACTGAGGCTGCGGGCACCACGC
GGGGTCCGGCCTGGGATCCAGGCTAAGGGCCGGCGGAAGAGGCCCCAATGGGGCGGTGACCCCAGCCTCGCCCGA
CAGAGCCCGGGGCGCAGGCGGGCGCCAGGGCGCTAATCCCGGCGCGGGTTCCGCTGACGCAGCGCCCCGCCTGGG
AGCCGCGGGCAGGCGAGACTGGCGGAGCCCCAGACCTCCCAGTGGGGACGGGCAGGGCCTGGCCTGGGAAGAG
CACAGCTGCAGATCCCAGGCCTCTGGCGCCCCACTCAAGACTACCAAAGCCAGGACACCTCAAGTCTCCAGCCC
CAATACCCCACCCCAATCCCGTATTCTTTTTTTTTTTTTTAGACAGGGTCTTGCTCCGTTGCCCAGGTTGGAG
TGCAGTGGCCCATCAGGGCTCACTGTAACCTCCGACTCCTGGGTTCAAGTGACCCTCCCACCTCAGCCTCTCAAG
TAGCTGGGACTACAGGTGCACCACCACACCTGGCTAATTTTTGTATTTTTTGTAAAGAGGGGGGTCTCACTGTGT
TGCCCAGGCTGGTTTCGAACTCCTGGGCTCAAGCGGTCCACCTGCCTCCGCCTCCCAAAGTGCTGGGATTGCAGG
CATGAGCCACTGCACCCAGCCCTGTATTCTTATTCTTCAGATATTTATTTTTCTTTTCACTGTTTTAAAATAAAA
CCAAAGTATTGATAAAAAAAAA
```

FIGURE 314

MWRCPLGLLLLLPLAGHLALGAQQGRGRRELAPGLHLRGIRDAGGRYCQEQDLCCRGRADDCA
LPYLGAICYCDLFCNRTVSDCCPDFWDFCLGVPPPFPPIQGCMHGGRIYPVLGTYWDNCNRCT
CQENRQWHGGSRHDQSHQPGQLWLAGWEPQRLLGHDPG

Important features:
N-glycosylation site.
amino acids 78-82, 161-165

Casein kinase II phosphorylation site.
amino acids 80-84, 117-121, 126-130, 169-173, 205-209, 296-300, 411-415

N-myristoylation site.
amino acids 21-27, 39-45, 44-50, 104-110, 160-164, 224-230, 269-275, 378-384, 442-448

Amidation site.
amino acids 26-30, 318-322

Eukaryotic thiol (cysteine) proteases histidine active site.
amino acids 398-409

FIGURE 315

CGGACGCGTGGGCCCCTGGTGGGCCCAGCAAGATGGATCTACTGTGGATCCTGCCCTCCCTGT
GGCTTCTCCTGCTTGGGGGGCCTGCCTGCCTGAAGACCCAGGAACACCCCAGCTGCCCAGGAC
CCAGGGAACTGGAAGCCAGCAAAGTTGTCCTCCTGCCCAGTTGTCCCGGAGCTCCAGGAAGTC
CTGGGGAGAAGGGAGCCCCAGGTCCTCAAGGGCCACCTGGACCACCAGGCAAGATGGGCCCCA
AGGGTGAGCCAGGCCCCAGAAACTGCCGGGAGCTGTTGAGCCAGGGCGCCACCTTGAGCGGCT
GGTACCATCTGTGCCTACCTGAGGGCAGGGCCCTCCCAGTCTTTTGTGACATGGACACCGAGG
GGGGCGGCTGGCTGGTGTTTCAGAGGCGCCAGGATGGTTCTGTGGATTTCTTCCGCTCTTGGT
CCTCCTACAGAGCAGGTTTTGGGAACCAAGAGTCTGAATTCTGGCTGGGAAATGAGAATTTGC
ACCAGCTTACTCTCCAGGGTAACTGGGAGCTGCGGGTAGAGCTGGAAGACTTTAATGGTAACC
GTACTTTCGCCCACTATGCGACCTTCCGCCTCCTCGGTGAGGTAGACCACTACCAGCTGGCAC
TGGGCAAGTTCTCAGAGGGCACTGCAGGGATTCCCTGAGCCTCCACAGTGGGAGGCCCTTTA
CCACCTATGACGCTGACCACGATTCAAGCAACAGCAACTGTGCAGTGATTGTCCACGGTGCCT
GGTGGTATGCATCCTGTTACCGATCAAATCTCAATGGTCGCTATGCAGTGTCTGAGGCTGCCG
CCCACAAATATGGCATTGACTGGGCCTCAGGCCGTGGTGTGGGCCACCCCTACCGCAGGGTTC
GGATGATGCTTCGATAGGGCACTCTGGCAGCCAGTGCCCTTATCTCTCCTGTACAGCTTCCGG
ATCGTCAGCCACCTTGCCTTTGCCAACCACCTCTGCTTGCCTGTCCACATTTAAAAATAAAAT
CATTTTAGCCCTTTCA

FIGURE 316

```
MDLLWILPSLWLLLLGGPACLKTQEHPSCPGPRELEASKVVLLPSCPGAPGSPGEKGAPGPQG
PPGPPGKMGPKGEPGPRNCRELLSQGATLSGWYHLCLPEGRALPVFCDMDTEGGGWLVFQRRQ
DGSVDFFRSWSSYRAGFGNQESEFWLGNENLHQLTLQGNWELRVELEDFNGNRTFAHYATFRL
LGEVDHYQLALGKFSEGTAGDSLSLHSGRPFTTYDADHDSSNSNCAVIVHGAWWYASCYRSNL
NGRYAVSEAAAHKYGIDWASGRGVGHPYRRVRMMLR
```

Important features:

Signal peptide:

Amino acids 1-16

N-glycosylation site:

Amino acids 178-182

Glycosaminoglycan attachment site:

Amino acids 272-276

Tyrosine kinase phosphorylation site:

Amino acids 188-197

N-myristoylation sites:

Amino acids 16-22;89-95;144-150;267-273

Fibrinogen beta and gamma chains C-terminal domain signature:

Amino acids 242-255

FIGURE 317

```
CCCAAGCCAGCCGAGCCGCCAGAGCCGCGGGCCGCGGGGGTGTCGCGGGCCCAACCCCAGGAT
GCTCCCCTGCGCCTCCTGCCTACCCGGGTCTCTACTGCTCTGGGCGCTGCTACTGTTGCTCTT
GGGATCAGCTTCTCCTCAGGATTCTGAAGAGCCCGACAGCTACACGGAATGCACAGATGGCTA
TGAGTGGGACCCAGACAGCCAGCACTGCCGGGATGTCAACGAGTGTCTGACCATCCCTGAGGC
CTGCAAGGGGGAAATGAAGTGCATCAACCACTACGGGGGCTACTTGTGCCTGCCCGCTCCGC
TGCCGTCATCAACGACCTACATGGCGAGGGACCCCGCCACCAGTGCCTCCCGCTCAACACCC
CAACCCCTGCCCACCAGGCTATGAGCCCGACGATCAGGACAGCTGTGTGGATGTGGACGAGTG
TGCCCAGGCCCTGCACGACTGTCGCCCCAGCCAGGACTGCCATAACTTGCCTGGCTCCTATCA
GTGCACCTGCCCTGATGGTTACCGCAAGATCGGGCCCGAGTGTGTGGACATAGACGAGTGCCG
CTACCGCTACTGCCAGCACCGCTGCGTGAACCTGCCTGGCTCCTTCCGCTGCCAGTGCGAGCC
GGGCTTCCAGCTGGGGCCTAACAACCGCTCCTGTGTTGATGTGAACGAGTGTGACATGGGGGC
CCCATGCGAGCAGCGCTGCTTCAACTCCTATGGGACCTTCCTGTGTCGCTGCCACCAGGGCTA
TGAGCTGCATCGGGATGGCTTCTCCTGCAGTGATATTGATGAGTGTAGCTACTCCAGCTACCT
CTGTCAGTACCGCTGCGTCAACGAGCCAGGCCGTTTCTCCTGCCACTGCCCACAGGGTTACCA
GCTGCTGGCCACACGCCTCTGCCAAGACATTGATGAGTGTGAGTCTGGTGCGCACCAGTGCTC
CGAGGCCCAAACCTGTGTCAACTTCCATGGGGGCTACCGCTGCGTGGACACCAACCGCTGCGT
GGAGCCCTACATCCAGGTCTCTGAGAACCGCTGTCTCTGCCCGGCCTCCAACCCTCTATGTCG
AGAGCAGCCTTCATCCATTGTGCACCGCTACATGACCATCACCTCGGAGCGGAGCGTGCCCGC
TGACGTGTTCCAGATCCAGGCGACCTCCGTCTACCCCGGTGCCTACAATGCCTTTCAGATCCG
TGCTGGAAACTCGCAGGGGACTTTTACATTAGGCAAATCAACAACGTCAGCGCCATGCTGGT
CCTCGCCCGGCCGGTGACGGGCCCCGGGAGTACGTGCTGGACCTGGAGATGGTCACCATGAA
TTCCCTCATGAGCTACCGGGCCAGCTCTGTACTGAGGCTCACCGTCTTTGTAGGGCCTACAC
CTTCTGAGGAGCAGGAGGGAGCCACCCTCCCTGCAGCTACCCTAGCTGAGGAGCCTGTTGTGA
GGGGCAGAATGAGAAAGGCAATAAAGGGAGAAAGAAAGTCCTGGTGGCTGAGGTGGGCGGGTC
ACACTGCAGGAAGCCTCAGGCTGGGGCAGGGTGGCACTTGGGGGGGCAGGCCAAGTTCACCTA
AATGGGGGTCTCTATATGTTCAGGCCCAGGGGCCCCCATTGACAGGAGCTGGGAGCTCTGCAC
CACGAGCTTCAGTCACCCCGAGAGGAGAGGAGGTAACGAGGAGGGCGGACTCCAGGCCCCGGC
CCAGAGATTTGGACTTGGCTGGCTTGCAGGGGTCCTAAGAAACTCCACTCTGGACAGCGCCAG
GAGGCCCTGGGTTCCATTCCTAACTCTGCCTCAAACTGTACATTTGGATAAGCCCTAGTAGTT
CCCTGGGCCTGTTTTTCTATAAAACGAGGCAACTGGAAAAAAAAAAAA
```

FIGURE 318

```
MLPCASCLPGSLLLWALLLLLLGSASPQDSEEPDSYTECTDGYEWDPDSQHCRDVNECLTIPE
ACKGEMKCINHYGGYLCLPRSAAVINDLHGEGPPPPVPPAQHPNPCPPGYEPDDQDSCVDVDE
CAQALHDCRPSQDCHNLPGSYQCTCPDGYRKIGPECVDIDECRYRYCQHRCVNLPGSFRCQCE
PGFQLGPNNRSCVDVNECDMGAPCEQRCFNSYGTFLCRCHQGYELHRDGFSCSDIDECSYSSY
LCQYRCVNEPGRFSCHCPQGYQLLATRLCQDIDECESGAHQCSEAQTCVNFHGGYRCVDTNRC
VEPYIQVSENRCLCPASNPLCREQPSSIVHRYMTITSERSVPADVFQIQATSVYPGAYNAFQI
RAGNSQGDFYIRQINNVSAMLVLARPVTGPREYVLDLEMVTMNSLMSYRASSVLRLTVFVGAYTF
```

Important features:

Signal sequence:

Amino acids 1-25

N-glycosylation sites:

Amino acids 198-202;394-398

N-myristoylation sites:

Amino acids 76-82;145-151;182-188;222-228;290-296;305-311;
371-377;381-387

Aspartic acid and asparagine hydroxylation sites:

amino acids 140-152;177-189;217-229;258-270

FIGURE 319

GCTGGGGAC<u>ATG</u>AGAGGCACACCGAAGACCCACCTCCTGGCCTTCTCCCTCCTCTGCCTCCTC
TCAAAGGTGCGTACCCAGCTGTGCCCGACACCATGTACCTGCCCCTGGCCACCTCCCCGATGC
CGCTGGGAGTACCCCTGGTGCTGGATGGCTGTGGCTGCTGCCGGGTATGTGCACGGCGGCTG
GGGGAGCCCTGCGACCAACTCCACGTCTGCGACGCCAGCCAGGGCCTGGTCTGCCAGCCCGGG
GCAGGACCCGGTGGCCGGGGGCCCTGTGCCTCTTGGCAGAGGACGACAGCAGCTGTGAGGTG
AACGGCCGCCTGTATCGGGAAGGGGAGACCTTCCAGCCCCACTGCAGCATCCGCTGCCGCTGC
GAGGACGGCGGCTTCACCTGCGTGCCGCTGTGCAGCGAGGATGTGCGGCTGCCCAGCTGGGAC
TGCCCCCACCCCAGGAGGGTCGAGGTCCTGGGCAAGTGCTGCCCTGAGTGGGTGTGCGGCCAA
GGAGGGGGACTGGGGACCCAGCCCCTTCCAGCCCAAGGACCCCAGTTTTCTGGCCTTGTCTCT
TCCCTGCCCCTGGTGTCCCTGCCCAGAATGGAGCACGGCCTGGGGACCCTGCTCGACCACC
TGTGGGCTGGGCATGGCCACCCGGGTGTCCAACCAGAACCGCTTCTGCCGACTGGAGACCCAG
CGCCGCCTGTGCCTGTCCAGGCCCTGCCCACCCTCCAGGGGTCGCAGTCCACAAAACAGTGCC
TTC<u>TAG</u>AGCCGGGCTGGGAATGGGGACACGGTGTCCACCATCCCCAGCTGGTGGCCCTGTGCC
TGGGCCCTGGGCTGATGGAAGATGGTCCGTGCCCAGGCCCTTGGCTGCAGGCAACACTTTAGC
TTGGGTCCACCATGCAGAACACCAATATTAACACGCTGCCTGGTCTGTCTGGATCCCGAGGTA
TGGCAGAGGTGCAAGACCTAGTCCCCTTTCCTCTAACTCACTGCCTAGGAGGCTGGCCAAGGT
GTCCAGGGTCCTCTAGCCCACTCCCTGCCTACACACACAGCCTATATCAAACATGCACACGGG
CGAGCTTTCTCTCCGACTTCCCCTGGGCAAGAGATGGGACAAGCAGTCCCTTAATATTGAGGC
TGCAGCAGGTGCTGGGCTGGACTGGCCATTTTTCTGGGGGTAGGATGAAGAGAAGGCACACAG
AGATTCTGGATCTCCTGCTGCCTTTTCTGGAGTTTGTAAAATTGTTCCTGAATACAAGCCTAT
GCGTGA

FIGURE 320

MRGTPKTHLLAFSLLCLLSKVRTQLCPTPCTCPWPPPRCPLGVPLVLDGCGCCRVCARRLGEP
CDQLHVCDASQGLVCQPGAGPGGRGALCLLAEDDSSCEVNGRLYREGETFQPHCSIRCRCEDG
GFTCVPLCSEDVRLPSWDCPHPRRVEVLGKCCPEWVCGQGGGLGTQPLPAQGPQFSGLVSSLP
PGVPCPEWSTAWGPCSTTCGLGMATRVSNQNRFCRLETQRRLCLSRPCPPSRGRSPQNSAF

Important features:

Signal sequence:
Amino acids 1-23

N-myristoylation sites:
Amino acids 3-9;49-55;81-87;85-91;126-132;164-170;166-172;
167-173;183-189;209-215

Insulin-like growth factor binding proteins signature:
Amino acids 49-65 von Willebrand C1 domain:
Amino acids 107-124

Thrombospondin 1 Homology Block:
Amino acids 201-216

IGF binding protein site:
Amino acids 49-58

FIGURE 321

```
AGAACCTCAGAAATGTGAGTTATTTGGGAATGGCTGTTTGTAAATGTCCTTACGTAAGCCAAG
AGGAGGTCTTGACTTGGGGTCCCAGGGGTACCGCAGATCCCAGGGACTGGAGCAGCACTAGCA
AGCTCTGGAGGATGAGCCAGGAGTCTGGAATTGAGGCTGAGCCAAAGACCCCAGGGCCGTCTC
AGTCTCATAAAAGGGGATCAGGCAGGAGGAGTTTGGGAGAAACCTGAGAAGGGCCTGATTTGC
AGCATCATGATGGGCCTCTCCTTGGCCTCTGCTGTGCTCCTGGCCTCCCTCCTGAGTCTCCAC
CTTGGAACTGCCACACGTGGGAGTGACATATCCAAGACCTGCTGCTTCCAATACAGCCACAAG
CCCCTTCCCTGGACCTGGGTGCGAAGCTATGAATTCACCAGTAACAGCTGCTCCCAGCGGGCT
GTGATATTCACTACCAAAAGAGGCAAGAAAGTCTGTACCCATCCAAGGAAAAAATGGGTGCAA
AAATACATTTCTTTACTGAAAACTCCGAAACAATTGTGACTCAGCTGAATTTTCATCCGAGGA
CGCTTGGACCCCGCTCTTGGCTCTGCAGCCCTCTGGGGAGCCTGCGGAATCTTTTCTGAAGGC
TACATGGACCCGCTGGGGAGGAGAGGGTGTTTCCTCCCAGAGTTACTTTAATAAAGGTTGTTC
ATAGAGTTGAAAAAAAAAAAAAAAAAAAAAAAAAAAAAAAAAAAAAAAAAAAAAAAAAAAAAA
AAAAAAAAAAAAAAAAAAAAAAAAA
```

FIGURE 322

MMGLSLASAVLLASLLSLHLGTATRGSDISKTCCFQYSHKPLPWTWVRSYEFTSNSCSQRAVI
FTTKRGKKVCTHPRKKWVQKYISLLKTPKQL

Important features:

Signal peptide:

amino acids 1-23

N-myristoylation sites.

amino acids 3-9, 26-32

Amidation site.

amino acids 68-72

Small cytokines (intecrine/chemokine).

amino acids 23-88

FIGURE 323

```
ACCGAGCCGAGCGGACCGAAGGCGCGCCCGAGATGCAGGTGAGCAAGAGGATGCTGGCGGGGGGCGTGAGGAGCA
TGCCCAGCCCCCTCCTGGCCTGCTGGCAGCCCATCCTCCTGCTGGTGCTGGGCTCAGTGCTGTCAGGCTCGGCCA
CGGGCTGCCCGCCCCGCTGCGAGTGCTCCGCCCAGGACCGCGCTGTGCTGTGCCACCGCAAGTGCTTTGTGGCAG
TCCCCGAGGGCATCCCCACCGAGACGCGCCTGCTGGACCTAGGCAAGAACCGCATCAAAACGCTCAACCAGGACG
AGTTCGCCAGCTTCCCGCACCTGGAGGAGCTGGAGCTCAACGAGAACATCGTGAGCGCCGTGGAGCCGGCGCCT
TCAACAACCTCTTCAACCTCCGGACGCTGGGTCTCCGCAGCAACCGCCTGAAGCTCATCCCGCTAGGCGTCTTCA
CTGGCCTCAGCAACCTGACCAAGCAGGACATCAGCGAGAACAAGATCGTTATCCTACTGGACTACATGTTTCAGG
ACCTGTACAACCTCAAGTCACTGGAGGTTGGCGACAATGACCTCGTCTACATCTCTCACCGCGCCTTCAGCGGCC
TCAACAGCCTGGAGCAGCTGACGCTGGAGAAATGCAACCTGACCTCCATCCCCACCGAGGCGCTGTCCCACCTGC
ACGGCCTCATCGTCCTGAGGCTCCGGCACCTCAACATCAATGCCATCCGGGACTACTCCTTCAAGAGGCTGTACC
GACTCAAGGTCTTGGAGATCTCCCACTGGCCCTACTTGGACACCATGACACCCAACTGCCTCTACGGCCTCAACC
TGACGTCCCTGTCCATCACACACTGCAATCTGACCGCTGTGCCCTACCTGGCCGTCCGCCACCTAGTCTATCTCC
GCTTCCTCAACCTCTCCTACAACCCCATCAGCACCATTGAGGGCTCCATGTTGCATGAGCTGCTCCGGCTGCAGG
AGATCCAGCTGGTGGGCGGGCAGCTGGCCGTGGTGGAGCCCTATGCCTTCCGCGGCCTCAACTACCTGCGCGTGC
TCAATGTCTCTGGCAACCAGCTGACCACACTGGAGGAATCAGTCTTCCACTCGGTGGGCAACCTGGAGACACTCA
TCCTGGACTCCAACCCGCTGGCCTGCGACTGTCGGCTCCTGTGGGTGTTCCGGCGCCGCTGGCGGCTCAACTTCA
ACCGGCAGCAGCCCACGTGCGCCACGCCCGAGTTTGTCCAGGGCAAGGAGTTCAAGGACTTCCCTGATGTGCTAC
TGCCCAACTACTTCACCTGCCGCCGCGCCCGCATCCGGGACCGCAAGGCCCAGCAGGTGTTTGTGGACGAGGGCC
ACACGGTGCAGTTTGTGTGCCGGGCCGATGGCGACCCGCCGCCCGCCATCCTCTGGCTCTCACCCCGAAAGCACC
TGGTCTCAGCCAAGAGCAATGGGCGGCTCACAGTCTTCCCTGATGGCACGCTGGAGGTGCGCTACGCCCAGGTAC
AGGACAACGGCACGTACCTGTGCATCGCGGCCAACGCGGGCGGCAACGACTCCATGCCCGCCCACCTGCATGTGC
GCAGCTACTCGCCCGACTGGCCCATCAGCCCAACAAGACCTTCGCTTTCATCTCCAACCAGCCGGGCGAGGGAG
AGGCCAACAGCACCCGCGCCACTGTGCCTTTCCCCTTCGACATCAAGACCCTCATCATCGCCACCACCATGGGCT
TCATCTCTTTCCTGGGCGTCGTCCTCTTCTGCCTGGTGCTGCTGTTTCTCTGGAGCCGGGGCAAGGGCAACACAA
AGCACAACATCGAGATCGAGTATGTGCCCCGAAAGTCGGACGCAGGCATCAGCTCCGCCGACGCGCCCCGCAAGT
TCAACATGAAGATGATATGAGGCCGGGGCGGGGGGCAGGGACCCCCGGGCGGCCGGGCAGGGGAAGGGGCCTGGT
CGCCACCTGCTCACTCTCCAGTCCTTCCCACCTCCTCCCTACCCTTCTACACACGTTCTCTTTCTCCCTCCCGCC
TCCGTCCCCTGCTGCCCCCGCCAGCCCTCACCACCTGCCCTCCTTCTACCAGGACCTCAGAAGCCCAGACCTGG
GGACCCCACCTACACAGGGGCATTGACAGACTGGAGTTGAAAGCCGACGAACCGACACGCGGCAGAGTCAATAAT
TCAATAAAAAAGTTACGAACTTTCTCTGTAACTTGGGTTTCAATAATTATGGATTTTTATGAAAACTTGAAATAA
TAAAAGAGAAAAAAACTAAAAAAAAAAAAAAAAAAAAA
```

FIGURE 324

MQVSKRMLAGGVRSMPSPLLACWQPILLLVLGSVLSGSATGCPPRCECSAQDRAVLCHRKCFVAVPEGIPTETRL
LDLGKNRIKTLNQDEFASFPHLEELELNENIVSAVEPGAFNNLFNLRTLGLRSNRLKLIPLGVFTGLSNLTKQDI
SENKIVILLDYMFQDLYNLKSLEVGDNDLVYISHRAFSGLNSLEQLTLEKCNLTSIPTEALSHLHGLIVLRLRHL
NINAIRDYSFKRLYRLKVLEISHWPYLDTMTPNCLYGLNLTSLSITHCNLTAVPYLAVRHLVYLRFLNLSYNPIS
TIEGSMLHELLRLQEIQLVGGQLAVVEPYAFRGLNYLRVLNVSGNQLTTLEESVFHSVGNLETLILDSNPLACDC
RLLWVFRRRWRLNFNRQQPTCATPEFVQGKEFKDFPDVLLPNYFTCRRARIRDRKAQQVFVDEGHTVQFVCRADG
DPPPAILWLSPRKHLVSAKSNGRLTVFPDGTLEVRYAQVQDNGTYLCIAANAGGNDSMPAHLHVRSYSPDWPHQP
NKTFAFISNQPGEGEANSTRATVPFPFDIKTLIIATTMGFISFLGVVLFCLVLLFLWSRGKGNTKHNIEIEYVPR
KSDAGISSADAPRKFNMKMI

Important features:
Signal sequence:
amino acids 1-41

Transmembrane domain:
amino acids 556-578

N-glycosylation site.
amino acids 144-148, 202-206, 264-268, 274-278, 293-297, 341-345, 492-496, 505-509, 526-530, 542-546

Casein kinase II phosphorylation site.
amino acids 49-53, 108-112, 146-150, 300-304, 348-352, 349-353, 607-611

Tyrosine kinase phosphorylation site.
amino acids 590-598

N-myristoylation site.
amino acids 10-16, 32-38, 37-43, 113-119, 125-131, 137-143, 262-268, 320-326, 344-350, 359-365, 493-499, 503-509, 605-611

Prokaryotic membrane lipoprotein lipid attachment site.
amino acids 32-43

FIGURE 325

```
CCCACGCGTCCGCCCACGCGTCCGAGGGACAAGAGAGAAGAGAGACTGAAACAGGGAGAAGAG
GCAGGAGAGGAGGAGGTGGGGAGAGCACGAAGCTGGAGGCCGACACTGAGGGAGGGCGGGAGG
AGGTGAAGAAGGAGAGAGGGGAGAAGAGGCAGGAGCTGGAAAGGAGAGAGGGAGGAGGAGGAG
GAGATGCGGGATGGAGACCTGGAGTTAGGTGGCTTGGGAGAGCTTAATGAAAAGAGAACGGAG
AGGAGGTGTGGGTTAGGAACCAAGAGGTAGCCCTGTGGGCAGCAGAAGGCTGAGAGGAGTAGG
AAGATCAGGAGCTAGAGGGAGACTGGAGGGTTCGGGAAAAGAGCAGAGGAAAGAGGAAAGAC
ACAGAGAGACGGGAGAGAGAAGAAGAGTGGGTTTGAAGGGCGGATCTCAGTCCCTGGCTGCTT
TGGCATTTGGGGAACTGGGACTCCCTGTGGGGAGGAGAGGAAAGCTGGAAGTCCTGGAGGGAC
AGGGTCCCAGAAGGAGGGGACAGAGGAGCTGAGAGAGGGGGGCAGGGCGTTGGGCAGGGGTCC
CTCGGAGGCCTCCTGGGGATGGGGGCTGCAGCTCGTCTGAGCGCCCCTCGAGCGCTGGTACTC
TGGGCTGCACTGGGGGCAGCAGCTCACATCGGACCAGCACCTGACCCCGAGGACTGGTGGAGC
TACAAGGATAATCTCCAGGGAAACTTCGTGCCAGGGCCTCCTTTCTGGGGCCTGGTGAATGCA
GCGTGGAGTCTGTGTGCTGTGGGGAAGCGGCAGAGCCCCGTGGATGTGGAGCTGAAGAGGGTT
CTTTATGACCCCTTTCTGCCCCATTAAGGCTCAGCACTGGAGGAGAGAAGCTCCGGGGAACC
TTGTACAACACCGGCCGACATGTCTCCTTCCTGCCTGCACCCCGACCTGTGGTCAATGTGTCT
GGAGGTCCCCTCCTTTACAGCCACCGACTCAGTGAACTGCGGCTGCTGTTTGGAGCTCGCGAC
GGAGCCGGCTCGGAACATCAGATCAACCACCAGGGCTTCTCTGCTGAGGTGCAGCTCATTCAC
TTCAACCAGGAACTCTACGGGAATTTCAGCGCTGCCTCCCGCGGCCCCAATGGCCTGGCCATT
CTCAGCCTCTTTGTCAACGTTGCCAGTACCTCTAACCCATTCCTCAGTCGCCTCCTTAACCGC
GACACCATCACTCGCATCTCCTACAAGAATGATGCCTACTTTCTTCAAGACCTGAGCCTGGAG
CTCCTGTTCCCTGAATCCTTCGGCTTCATCACCTATCAGGGCTCTCTCAGCACCCCGCCCTGC
TCCGAGACTGTCACCTGGATCCTCATTGACCGGGCCCTCAATATCACCTCCCTTCAGATGCAC
TCCCTGAGACTCCTGAGCCAGAATCCTCCATCTCAGATCTTCCAGAGCCTCAGCGGTAACAGC
CGGCCCCTGCAGCCCTTGGCCCACAGGGCACTGAGGGGCAACAGGGACCCCCGGCACCCCGAG
AGGCGCTGCCGAGGCCCCAACTACCGCCTGCATGTGGATGGTGTCCCCATGGTCGCTGAGAC
TCCCCTTCGAGGATTGCACCCGCCCGTCCTAAGCCTCCCCACAAGGCGAGGGGAGTTACCCCT
AAAACAAAGCTATTAAAGGGACAGAATACTTA
```

FIGURE 326

MGAAARLSAPRALVLWAALGAAAHIGPAPDPEDWWSYKDNLQGNFVPGPPFWGLVNAAWSLCA
VGKRQSPVDVELKRVLYDPFLPPLRLSTGGEKLRGTLYNTGRHVSFLPAPRPVVNVSGGPLLY
SHRLSELRLLFGARDGAGSEHQINHQGFSAEVQLIHFNQELYGNFSAASRGPNGLAILSLFVN
VASTSNPFLSRLLNRDTITRISYKNDAYFLQDLSLELLFPESFGFITYQGSLSTPPCSETVTW
ILIDRALNITSLQMHSLRLLSQNPPSQIFQSLSGNSRPLQPLAHRALRGNRDPRHPERRCRGP
NYRLHVDGVPHGR

Important features:

Signal peptide:

Amino acids 1-23

Transmembrane domain:

Amino acids 177-199

N-glycosylation sites:

Amino acids 118-122;170-174;260-264

Eukaryotic-type carbonic anhydrases proteins:

Amino acids 222-271;128-165;45-93

FIGURE 327

```
GGACTAATCTGTGGGAGCAGTTTATTCCAGTATCACCCAGGGTGCAGCCACACCAGGACTGTGTTGAAGGGTGTT
TTTTTTCTTTTAAATGTAATACCTCCTCATCTTTTCTTCTTACACAGTGTCTGAGAACATTTACATTATAGATAA
GTAGTACATGGTGGATAACTTCTACTTTTAGGAGGACTACTCTCTTCTGACAGTCCTAGACTGGTCTTCTACACT
AAGACACCATGAAGGAGTATGTGCTCCTATTATTCCTGGCTTTGTGCTCTGCCAAACCCTTCTTTAGCCCTTCAC
ACATCGCACTGAAGAATATGATGCTGAAGGATATGGAAGACACAGATGATGATGATGATGATGATGATGATGATG
ATGATGATGAGGACAACTCTCTTTTTCCAACAAGAGAGCCAAGAAGCCATTTTTTTCCATTTGATCTGTTTCCAA
TGTGTCCATTTGGATGTCAGTGCTATTCACGAGTTGTACATTGCTCAGATTTAGGTTTGACCTCAGTCCCAACCA
ACATTCCATTTGATACTCGAATGCTTGATCTTCAAAACAATAAAATTAAGGAAATCAAAGAAAATGATTTTAAAG
GACTCACTTCACTTTATGGTCTGATCCTGAACAACAACAAGCTAACGAAGATTCACCCAAAAGCCTTTCTAACCA
CAAAGAAGTTGCGAAGGCTGTATCTGTCCCACAATCAACTAAGTGAAATACCACTTAATCTTCCCAAATCATTAG
CAGAACTCAGAATTCATGAAAATAAAGTTAAGAAAATACAAAAGGACACATTCAAAGGAATGAATGCTTTACACG
TTTTGGAAATGAGTGCAAACCCTCTTGATAATAATGGGATAGAGCCAGGGGCATTTGAAGGGGTGACGGTGTTCC
ATATCAGAATTGCAGAAGCAAAACTGACCTCAGTTCCTAAAGGCTTACCACCAACTTTATTGGAGCTTCACTTAG
ATTATAATAAAATTTCAACAGTGGAACTTGAGGATTTTAAACGATACAAAGAACTACAAAGGCTGGGCCTAGGAA
ACAACAAAATCACAGATATCGAAAATGGGAGTCTTGCTAACATACCACGTGTGAGAGAAATACATTTGGAAAACA
ATAAACTAAAAAAAATCCCTTCAGGATTACCAGAGTTGAAATACCTCCAGATAATCTTCCTTCATTCTAATTCAA
TTGCAAGAGTGGGAGTAAATGACTTCTGTCCAACAGTGCCAAAGATGAAGAAATCTTTATACAGTGCAATAAGTT
TATTCAACAACCCGGTGAAATACTGGGAAATGCAACCTGCAACATTTCGTTGTGTTTTGAGCAGAATGAGTGTTC
AGCTTGGGAACTTTGGAATGTAATAATTAGTAATTGGTAATGTCCATTTAATATAAGATTCAAAAATCCCTACAT
TTGGAATACTTGAACTCTATTAATAATGGTAGTATTATATATACAAGCAAATATCTATTCTCAAGTGGTAAGTCC
ACTGACTTATTTTATGACAAGAAATTTCAACGGAATTTTGCCAAACTATTGATACATAAGGGGTTGAGAGAAACA
AGCATCTATTGCAGTTTCCTTTTTGCGTACAAATGATCTTACATAAATCTCATGCTTGACCATTCCTTTCTTCAT
AACAAAAAAGTAAGATATTCGGTATTTAACACTTTGTTATCAAGCACATTTTAAAAAGAACTGTACTGTAAATGG
AATGCTTGACTTAGCAAAATTTGTGCTCTTTCATTTGCTGTTAGAAAAACAGAATTAACAAAGACAGTAATGTGA
AGAGTGCATTACACTATTCTTATTCTTTAGTAACTTGGGTAGTACTGTAATATTTTAATCATCTTAAAGTATGA
TTTGATATAATCTTATTGAAATTACCTTATCATGTCTTAGAGCCCGTCTTTATGTTTAAAACTAATTTCTTAAAA
TAAAGCCTTCAGTAAATGTTCATTACCAACTTGATAAATGCTACTCATAAGAGCTGGTTTGGGGCTATAGCATAT
GCTTTTTTTTTTTAATTATTACCTGATTTAAAAATCTCTGTAAAAACGTGTAGTGTTTCATAAAATCTGTAACT
CGCATTTTAATGATCCGCTATTATAAGCTTTTAATAGCATGAAAATTGTTAGGCTATATAACATTGCCACTTCAA
CTCTAAGGAATATTTTTGAGATATCCCTTTGGAAGACCTTGCTTGGAAGAGCCTGGACACTAACAATTCTACACC
AAATTGTCTCTTCAAATACGTATGGACTGGATAACTCTGAGAAACACATCTAGTATAACTGAATAAGCAGAGCAT
CAAATTAAACAGACAGAAACCGAAAGCTCTATATAAATGCTCAGAGTTCTTTATGTATTTCTTATTGGCATTCAA
CATATGTAAAATCAGAAAACAGGGAAATTTTCATTAAAAATATTGGTTTGAAAT
```

FIGURE 328

MKEYVLLLFLALCSAKPFFSPSHIALKNMMLKDMEDTDDDDDDDDDDDDEDNSLFPTREPRS
HFFPFDLFPMCPFGCQCYSRVVHCSDLGLTSVPTNIPFDTRMLDLQNNKIKEIKENDFKGLTS
LYGLILNNNKLTKIHPKAFLTTKKLRRLYLSHNQLSEIPLNLPKSLAELRIHENKVKKIQKDT
FKGMNALHVLEMSANPLDNNGIEPGAFEGVTVFHIRIAEAKLTSVPKGLPPTLLELHLDYNKI
STVELEDFKRYKELQRLGLGNNKITDIENGSLANIPRVREIHLENNKLKKIPSGLPELKYLQI
IFLHSNSIARVGVNDFCPTVPKMKKSLYSAISLFNNPVKYWEMQPATFRCVLSRMSVQLGNFGM

Important features:
Signal sequence.
amino acids 1-15

N-glycosylation site.
amino acids 281-285

N-myristoylation sites.
amino acids 129-135, 210-216, 214-220, 237-243, 270-276, 282-288

Leucine zipper pattern.
amino acids 154-176

FIGURE 329

GGGGTCTCCCTCAGGGCCGGGAGGCACAGCGGTCCCTGCTTGCTGAAGGGCTGGATGTACGCA
TCCGCAGGTTCCCGCGGACTTGGGGGCGCCCGCTGAGCCCCGGCGCCCGCAGAAGACTTGTGT
TTGCCTCCTGCAGCCTCAACCCGGAGGGCAGCGAGGGCCTACCACATGATCACTGGTGTGTT
CAGCATGCGCTTGTGGACCCCAGTGGGCGTCCTGACCTCGCTGGCGTACTGCCTGCACCAGCG
GCGGGTGGCCCTGGCCGAGCTGCAGGAGGCCGATGGCCAGTGTCCGGTCGACCGCAGCCTGCT
GAAGTTGAAAATGGTGCAGGTCGTGTTTCGACACGGGGCTCGGAGTCCTCTCAAGCCGCTCCC
GCTGGAGGAGCAGGTAGAGTGGAACCCCCAGCTATTAGAGGTCCCACCCCAAACTCAGTTTGA
TTACACAGTCACCAATCTAGCTGGTGGTCCGAAACCATATTCTCCTTACGACTCTCAATACCA
TGAGACCACCCTGAAGGGGGGCATGTTTGCTGGGCAGCTGACCAAGGTGGGCATGCAGCAAAT
GTTTGCCTTGGGAGAGAGACTGAGGAAGAACTATGTGGAAGACATTCCCTTTCTTTCACCAAC
CTTCAACCCACAGGAGGTCTTTATTCGTTCCACTAACATTTTTCGGAATCTGGAGTCCACCCG
TTGTTTGCTGGCTGGGCTTTTCCAGTGTCAGAAAGAAGGACCCATCATCATCCACACTGATGA
AGCAGATTCAGAAGTCTTGTATCCCAACTACCAAGCTGCTGGAGCCTGAGGCAGAGAACCAG
AGGCCGGAGGCAGACTGCCTCTTTACAGCCAGGAATCTCAGAGGATTTGAAAAAGGTGAAGGA
CAGGATGGGCATTGACAGTAGTGATAAAGTGGACTTCTTCATCCTCCTGGACAACGTGGCTGC
CGAGCAGGCACACAACCTCCCAAGCTGCCCCATGCTGAAGAGATTTGCACGGATGATCGAACA
GAGAGCTGTGGACACATCCTTGTACATACTGCCCAAGGAAGACAGGGAAAGTCTTCAGATGGC
AGTAGGCCCATTCCTCCACATCCTAGAGAGCAACCTGCTGAAAGCCATGGACTCTGCCACTGC
CCCCGACAAGATCAGAAAGCTGTATCTCTATGCGGCTCATGATGTGACCTTCATACCGCTCTT
AATGACCCTGGGGATTTTTGACCACAAATGGCCACCGTTTGCTGTTGACCTGACCATGGAACT
TTACCAGCACCTGGAATCTAAGGAGTGGTTTGTGCAGCTCTATTACCACGGGAAGGAGCAGGT
GCCGAGAGGTTGCCCTGATGGGCTCTGCCCGCTGGACATGTTCTTGAATGCCATGTCAGTTTA
TACCTTAAGCCCAGAAAAATACCATGCACTCTGCTCTCAAACTCAGGTGATGGAAGTTGGAAA
TGAAGAGTAACTGATTTATAAAGCAGGATGTGTTGATTTTAAAATAAAGTGCCTTTATACAATG

FIGURE 330

```
MITGVFSMRLWTPVGVLTSLAYCLHQRRVALAELQEADGQCPVDRSLLKLKMVQVVFRHGARSPLKPLPLEEQVE
WNPQLLEVPPQTQFDYTVTNLAGGPKPYSPYDSQYHETTLKGGMFAGQLTKVGMQQMFALGERLRKNYVEDIPFL
SPTFNPQEVFIRSTNIFRNLESTRCLLAGLFQCQKEGPIIIHTDEADSEVLYPNYQSCWSLRQRTRGRRQTASLQ
PGISEDLKKVKDRMGIDSSDKVDFFILLDNVAAEQAHNLPSCPMLKRFARMIEQRAVDTSLYILPKEDRESLQMA
VGPFLHILESNLLKAMDSATAPDKIRKLYLYAAHDVTFIPLLMTLGIFDHKWPPFAVDLTMELYQHLESKEWFVQ
LYYHGKEQVPRGCPDGLCPLDMFLNAMSVYTLSPEKYHALCSQTQVMEVGNEE
```

Important features:
Signal sequence:
amino acids 1-23 cAMP- and cGMP-dependent protein kinase phosphorylation site.
amino acids 218-222

Casein kinase II phosphorylation site.
amino acids 87-91, 104-108, 320-324

Tyrosine kinase phosphorylation site.
amino acids 280-288

N-myristoylation site.
amino acids 15-21, 117-123, 118-124, 179-185, 240-246, 387-393

Amidation site.
amino acids 216-220

Leucine zipper pattern.
amino acids 10-32

Histidine acid phosphatases phosphohistidine signature.
amino acids 50-65

FIGURE 331

```
CGAGGGCTTTTCCGGCTCCGGAATGGCACATGTGGGAATCCCAGTCTTGTTGGCTACAACATTTTTCCCTTTCCT
AACAAGTTCTAACAGCTGTTCTAACAGCTAGTGATCAGGGGTTCTTCTTGCTGGAGAAGAAAGGGCTGAGGGCAG
AGCAGGGCACTCTCACTCAGGGTGACCAGCTCCTTGCCTCTCTGTGGATAACAGAGCATGAGAAAGTGAAGAGAT
GCAGCGGAGTGAGGTGATGGAAGTCTAAAATAGGAAGGAATTTTGTGTGCAATATCAGACTCTGGGAGCAGTTGA
CCTGGAGAGCCTGGGGGAGGGCCTGCCTAACAAGCTTTCAAAAAACAGGAGCGACTTCCACTGGGCTGGGATAAG
ACGTGCCGGTAGGATAGGGAAGACTGGGTTTAGTCCTAATATCAAATTGACTGGCTGGGTGAACTTCAACAGCCT
TTTAACCTCTCTGGGAGATGAAAACGATGGCTTAAGGGGCCAGAAATAGAGATGCTTTGTAAAATAAAATTTTAA
AAAAAGCAAGTATTTTATAGCATAAAGGCTAGAGACCAAAATAGATAACAGGATTCCCTGAACATTCCTAAGAGG
GAGAAAGTATGTTAAAAATAGAAAAACCAAAATGCAGAAGGAGGAGACTCACAGAGCTAAACCAGGATGGGGACC
CTGGGTCAGGCCAGCCTCTTTGCTCCTCCCGGAAATTATTTTTGGTCTGACCACTCTGCCTTGTGTTTTGCAGAA
TCATGTGAGGGCCAACCGGGGAAGGTGGAGCAGATGAGCACACACAGGAGCCGTCTCCTCACCGCCGCCCCTCTC
AGCATGGAACAGAGGCAGCCCTGGCCCGGGCCCTGGAGGTGGACAGCCGCTCTGTGGTCCTGCTCTCAGTGGTC
TGGGTGCTGCTGGCCCCCCAGCAGCCGGCATGCCTCAGTTCAGCACCTTCCACTCTGAGAATCGTGACTGGACC
TTCAACCACTTGACCGTCCACCAAGGGACGGGGCCGTCTATGTGGGGGCCATCAACCGGGTCTATAAGCTGACA
GGCAACCTGACCATCCAGGTGGCTCATAAGACAGGGCCAGAAGAGGACAACAAGTCTCGTTACCCGCCCCTCATC
GTGCAGCCCTGCAGCGAAGTGCTCACCCTCACCAACAATGTCAACAAGCTGCTCATCATTGACTACTCTGAGAAC
CGCCTGCTGGCCTGTGGGAGCCTCTACCAGGGGGTCTGCAAGCTGCTGCGGCTGGATGACCTCTTCATCCTGGTG
GAGCCATCCCACAAGAAGGAGCACTACCTGTCCAGTGTCAACAAGACGGGCACCATGTACGGGGTGATTGTGCGC
TCTGAGGGTGAGGATGGCAAGCTCTTCATCGGCACGGCTGTGGATGGGAAGCAGGATTACTTCCCGACCCTGTCC
AGCCGGAAGCTGCCCCGAGACCCTGAGTCCTCAGCCATGCTCGACTATGAGCTACACAGCGATTTTGTCTCCTCT
CTCATCAAGATCCCTTCAGACACCCTGGCCCTGGTCTCCCACTTTGACATCTTCTACATCTACGGCTTTGCTAGT
GGGGGCTTTGTCTACTTTCTCACTGTCCAGCCCGAGACCCCTGAGGGTGTGGCCATCAACTCCGCTGGAGACCTC
TTCTACACCTCACGCATCGTGCGGCTCTGCAAGGATGACCCCAAGTTCCACTCATACGTGTCCCTGCCCTTCGGC
TGCACCCGGGCCGGGGTGGAATACCGCCTCCTGCAGGCTGCTTACCTGGCCAAGCCTGGGGACTCACTGGCCCAG
GCCTTCAATATCACCAGCCAGGACGATGTACTCTTTGCCATCTTCTCCAAAGGGCAGAAGCAGTATCACCACCCG
CCCGATGACTCTGCCCTGTGTGCCTTCCCTATCCGGGCCATCAACTTGCAGATCAAGGAGCGCCTGCAGTCCTGC
TACCAGGGCGAGGGCAACCTGGAGCTCAACTGGCTGCTGGGGAAGGACGTCCAGTGCACGAAGGCGCCTGTCCCC
ATCGATGATAACTTCTGTGGACTGGACATCAACCAGCCCCTGGGAGGCTCAACTCCAGTGGAGGGCCTGACCCTG
TACACCACCAGCAGGGACCGCATGACCTCTGTGGCCTCCTACGTTTACAACGGCTACAGCGTGGTTTTTGTGGGG
ACTAAGAGTGGCAAGCTGAAAAAGGTAAGAGTCTATGAGTTCAGATGCTCCAATGCCATTCACCTCCTCAGCAAA
GAGTCCCTCTTGGAAGGTAGCTATTGGTGGAGATTTAACTATAGGCAACTTTATTTTCTTGGGGAACAAAGGTGA
AATGGGGAGGTAAGAAGGGGTTAATTTTGTGACTTAGCTTCTAGCTACTTCCTCCAGCCATCAGTCATTGGGTAT
GTAAGGAATGCAAGCGTATTTCAATATTTCCCAAACTTTAAGAAAAAACTTTAAGAAGGTACATCTGCAAAAGCAAA
```

FIGURE 332

MGTLGQASLFAPPGNYFWSDHSALCFAESCEGQPGKVEQMSTHRSRLLTAAPLSMEQRQPWPR
ALEVDSRSVVLLSVVWVLLAPPAAGMPQFSTFHSENRDWTFNHLTVHQGTGAVYVGAINRVYK
LTGNLTIQVAHKTGPEEDNKSRYPPLIVQPCSEVLTLTNNVNKLLIIDYSENRLLACGSLYQG
VCKLLRLDDLFILVEPSHKKEHYLSSVNKTGTMYGVIVRSEGEDGKLFIGTAVDGKQDYFPTL
SSRKLPRDPESSAMLDYELHSDFVSSLIKIPSDTLALVSHFDIFYIYGFASGGFVYFLTVQPE
TPEGVAINSAGDLFYTSRIVRLCKDDPKFHSYVSLPFGCTRAGVEYRLLQAAYLAKPGDSLAQ
AFNITSQDDVLFAIFSKGQKQYHHPPDDSALCAFPIRAINLQIKERLQSCYQGEGNLELNWLL
GKDVQCTKAPVPIDDNFCGLDINQPLGGSTPVEGLTLYTTSRDRMTSVASYVYNGYSVVFVGT
KSGKLKKVRVYEFRCSNAIHLLSKESLLEGSYWWRFNYRQLYFLGEQR

Important features:

Signal sequence:
amino acids 1-32

Transmembrane domain:
amino acids 71-87

N-glycosylation site.
amino acids 130-134, 145-149, 217-221, 381-385

Casein kinase II phosphorylation site.
amino acids 139-143, 229-233, 240-244, 291-295, 324-328, 383-387, 384-388, 471-475, 481-485, 530-534

N-myristoylation site.
amino acids 220-226, 319-325, 353-359, 460-466, 503-509

FIGURE 333

GCTGAGTCTGCTGCTCCTGCTGCTGCTGCTCCAGCCTGTAACCTGTGCCTACACCACGCCAGG
CCCCCCAGAGCCCTCACCACGCTGGGCGCCCCAGAGCCCACACCATGCCGGGCACCTACGC
TCCCTCGACCACACTCAGTAGTCCCAGCACCCAGGGCCTGCAAGAGCAGGCACGGGCCCTGAT
GCGGGACTTCCCGCTCGTGGACGGCCACAACGACCTGCCCCTGGTCCTAAGGCAGGTTTACCA
GAAAGGGCTACAGGATGTTAACCTGCGCAATTTCAGCTACGGCCAGACCAGCCTGGACAGGCT
TAGAGATGGCCTCGTGGGCGCCCAGTTCTGGTCAGCCTATGTGCCATGCCAGACCCAGGACCG
GGATGCCCTGCGCCTCACCCTGGAGCAGATTGACCTCATACGCCGCATGTGTGCCTCCTATTC
TGAGCTGGAGCTTGTGACCTCGGCTAAAGCTCTGAACGACACTCAGAAATTGGCCTGCCTCAT
CGGTGTAGAGGGTGGCCACTCGCTGGACAATAGCCTCTCCATCTTACGTACCTTCTACATGCT
GGGAGTGCGCTACCTGACGCTCACCCACACCTGCAACACACCCTGGGCAGAGAGCTCCGCTAA
GGGCGTCCACTCCTTCTACAACAACATCAGCGGGCTGACTGACTTTGGTGAGAAGGTGGTGGC
AGAAATGAACCGCCTGGGCATGATGGTAGACTTATCCCATGTCTCAGATGCTGTGGCACGGCG
GGCCCTGGAAGTGTCACAGGCACCTGTGATCTTCTCCCACTCGGCTGCCCGGGGTGTGTGCAA
CAGTGCTCGGAATGTTCCTGATGACATCCTGCAGCTTCTGAAGAAGAACGGTGGCGTCGTGAT
GGTGTCTTTGTCCATGGGAGTAATACAGTGCAACCCATCAGCCAATGTGTCCACTGTGGCAGA
TCACTTCGACCACATCAAGGCTGTCATTGGATCCAAGTTCATCGGGATTGGTGGAGATTATGA
TGGGGCCGGCAAATTCCCTCAGGGGCTGGAAGACGTGTCCACATACCCGGTCCTGATAGAGGA
GTTGCTGAGTCGTGGCTGGAGTGAGGAAGAGCTTCAGGGTGTCCTTCGTGGAAACCTGCTGCG
GGTCTTCAGACAAGTGGAAAAGGTACAGGAAGAAAACAAATGGCAAAGCCCCTTGGAGGACAA
GTTCCCGGATGAGCAGCTGAGCAGTTCCTGCCACTCCGACCTCTCACGTCTGCGTCAGAGACA
GAGTCTGACTTCAGGCCAGGAACTCACTGAGATTCCCATACACTGGACAGCCAAGTTACCAGC
CAAGTGGTCAGTCTCAGAGTCCTCCCCCCACATGGCCCCAGTCCTTGCAGTTGTGGCCACCTT
CCCAGTCCTTATTCTGTGGCTCTGATGACCCAGTTAGTCCTGCCAGATGTCACTGTAGCAAGC
CACAGACACCCCACAAAGTTCCCCTGTTGTGCAGGCACAAATATTTCCTGAAATAAATGTTTT
GGACATAG

FIGURE 334

MPGTYAPSTTLSSPSTQGLQEQARALMRDFPLVDGHNDLPLVLRQVYQKGLQDVNLRNFSYGQ
TSLDRLRDGLVGAQFWSAYVPCQTQDRDALRLTLEQIDLIRRMCASYSELELVTSAKALNDTQ
KLACLIGVEGGHSLDNSLSILRTFYMLGVRYLTLTHTCNTPWAESSAKGVHSFYNNISGLTDF
GEKVVAEMNRLGMMVDLSHVSDAVARRALEVSQAPVIFSHSAARGVCNSARNVPDDILQLLKK
NGGVVMVSLSMGVIQCNPSANVSTVADHFDHIKAVIGSKFIGIGGDYDGAGKFPQGLEDVSTY
PVLIEELLSRGWSEEELQGVLRGNLLRVFRQVEKVQEENKWQSPLEDKFPDEQLSSSCHSDLS
RLRQRQSLTSGQELTEIPIHWTAKLPAKWSVSESSPHMAPVLAVVATFPVLILWL

Important features:
N-glycosylation sites.
amino acids 58-62, 123-127, 182-186, 273-277

N-myristoylation sites.
amino acids 72-78, 133-139, 234-240, 264-270, 334-340, 389-395

Renal dipeptidase active site.
amino acids 134-157

FIGURE 335

```
CCCAGAAGTTCAAGGGCCCCCGGCCTCCTGCGCTCCTGCCGCCGGGACCCTCGACCTCCTCAG
AGCAGCCGGCTGCCGCCCCGGGAAGATGGCGAGGAGGAGCCGCCACCGCCTCCTCCTGCTGCT
GCTGCGCTACCTGGTGGTCGCCCTGGGCTATCATAAGGCCTATGGGTTTTCTGCCCCAAAAGA
CCAACAAGTAGTCACAGCAGTAGAGTACCAAGAGGCTATTTTAGCCTGCAAAACCCCAAAGAA
GACTGTTTCCTCCAGATTAGAGTGGAAGAAACTGGGTCGGAGTGTCTCCTTTGTCTACTATCA
ACAGACTCTTCAAGGTGATTTTAAAAATCGAGCTGAGATGATAGATTTCAATATCCGGATCAA
AAATGTGACAAGAAGTGATGCGGGGAAATATCGTTGTGAAGTTAGTGCCCCATCTGAGCAAGG
CCAAAACCTGGAAGAGGATACAGTCACTCTGGAAGTATTAGTGGCTCCAGCAGTTCCATCATG
TGAAGTACCCTCTTCTGCTCTGAGTGGAACTGTGGTAGAGCTACGATGTCAAGACAAAGAAGG
GAATCCAGCTCCTGAATACACATGGTTTAAGGATGGCATCCGTTTGCTAGAAAATCCCAGACT
TGGCTCCCAAAGCACCAACAGCTCATACACAATGAATACAAAAACTGGAACTCTGCAATTTAA
TACTGTTTCCAAACTGGACACTGGAGAATATTCCTGTGAAGCCCGCAATTCTGTTGGATATCG
CAGGTGTCCTGGGAAACGAATGCAAGTAGATGATCTCAACATAAGTGGCATCATAGCAGCCGT
AGTAGTTGTGGCCTTAGTGATTTCCGTTTGTGGCCTTGGTGTATGCTATGCTCAGAGGAAAGG
CTACTTTTCAAAAGAAACCTCCTTCCAGAAGAGTAATTCTTCATCTAAAGCCACGACAATGAG
TGAAAATGTGCAGTGGCTCACGCCTGTAATCCCAGCACTTTGGAAGGCCGCGGCGGGCGGATC
ACGAGGTCAGGAGTTCTAGACCAGTCTGGCCAATATGGTGAAACCCCATCTCTACTAAAATAC
AAAAATTAGCTGGGCATGGTGGCATGTGCCTGCAGTTCCAGCTGCTTGGGAGACAGGAGAATC
ACTTGAACCCGGGAGGCGGAGGTTGCAGTGAGCTGAGATCACGCCACTGCAGTCCAGCCTGGG
TAACAGAGCAAGATTCCATCTCAAAAAATAAATAAATAAATAAATACTGGTTTTTACC
TGTAGAATTCTTACAATAAATATAGCTTGATATTC
```

FIGURE 336

MARRSRHRLLLLLLRYLVVALGYHKAYGFSAPKDQQVVTAVEYQEAILACKTPKKTVSSRLEW
KKLGRSVSFVYYQQTLQGDFKNRAEMIDFNIRIKNVTRSDAGKYRCEVSAPSEQGQNLEEDTV
TLEVLVAPAVPSCEVPSSALSGTVVELRCQDKEGNPAPEYTWFKDGIRLLENPRLGSQSTNSS
YTMNTKTGTLQFNTVSKLDTGEYSCEARNSVGYRRCPGKRMQVDDLNISGIIAAVVVVALVIS
VCGLGVCYAQRKGYFSKETSFQKSNSSSKATTMSENVQWLTPVIPALWKAAAGGSRGQEF

Important features:

Signal peptide:

amino acids 1-20

Transmembrane domain:

amino acids 130-144, 238-258

N-glycosylation site.

amino acids 98-102, 187-191, 236-240, 277-281

Casein kinase II phosphorylation site.

amino acids 39-43, 59-63, 100-104, 149-153, 205-209, 284-288

N-myristoylation site.

amino acids 182-188, 239-245, 255-261, 257-263, 305-311

Amidation site.

amino acids 226-230

FIGURE 337

```
GGAGCCGCCCTGGGTGTCAGCGGCTCGGCTCCCGCGCACGCTCCGGCCGTCGCGCAGCCTCGG
CACCTGCAGGTCCGTGCGTCCCGCGGCTGGCGCCCCTGACTCCGTCCCGGCCAGGGAGGGCCA
TGATTTCCCTCCCGGGGCCCCTGGTGACCAACTTGCTGCGGTTTTTGTTCCTGGGGCTGAGTG
CCCTCGCGCCCCCTCGCGGGCCCAGCTGCAACTGCACTTGCCCGCCAACCGGTTGCAGGCGG
TGGAGGGAGGGAAGTGGTGCTTCCAGCGTGGTACACCTTGCACGGGGAGGTGTCTTCATCCC
AGCCATGGGAGGTGCCCTTTGTGATGTGGTTCTTCAAACAGAAAGAAAAGGAGGATCAGGTGT
TGTCCTACATCAATGGGGTCACAACAAGCAAACCTGGAGTATCCTTGGTCTACTCCATGCCCT
CCCGGAACCTGTCCCTGCGGCTGGAGGGTCTCCAGGAGAAAGACTCTGGCCCCTACAGCTGCT
CCGTGAATGTGCAAGACAAACAAGGCAAATCTAGGGGCCACAGCATCAAAACCTTAGAACTCA
ATGTACTGGTTCCTCCAGCTCCTCCATCCTGCCGTCTCCAGGGTGTGCCCCATGTGGGGGCAA
ACGTGACCCTGAGCTGCCAGTCTCCAAGGAGTAAGCCCGCTGTCCAATACCAGTGGGATCGGC
AGCTTCCATCCTTCCAGACTTTCTTTGCACCAGCATTAGATGTCATCCGTGGGTCTTTAAGCC
TCACCAACCTTTCGTCTTCCATGGCTGGAGTCTATGTCTGCAAGGCCCACAATGAGGTGGGCA
CTGCCCAATGTAATGTGACGCTGGAAGTGAGCACAGGGCCTGGAGCTGCAGTGGTTGCTGGAG
CTGTTGTGGGTACCCTGGTTGGACTGGGGTTGCTGGCTGGGCTGGTCCTCTTGTACCACCGCC
GGGGCAAGGCCCTGGAGGAGCCAGCCAATGATATCAAGGAGGATGCCATTGCTCCCCGGACCC
TGCCCTGGCCCAAGAGCTCAGACACAATCTCCAAGAATGGGACCCTTTCCTCTGTCACCTCCG
CACGAGCCCTCCGGCCACCCCATGGCCCTCCCAGGCCTGGTGCATTGACCCCCACGCCCAGTC
TCTCCAGCCAGGCCCTGCCCTCACCAAGACTGCCCACGACAGATGGGGCCCACCCTCAACCAA
TATCCCCCATCCCTGGTGGGGTTTCTTCCTCTGGCTTGAGCCGCATGGGTGCTGTGCCTGTGA
TGGTGCCTGCCCAGAGTCAAGCTGGCTCTCTGGTATGATGACCCCACCACTCATTGGCTAAAG
GATTTGGGGTCTCTCCTTCCTATAAGGGTCACCTCTAGCACAGAGGCCTGAGTCATGGGAAAG
AGTCACACTCCTGACCCTTAGTACTCTGCCCCCACCTCTCTTTACTGTGGGAAAACCATCTCA
GTAAGACCTAAGTGTCCAGGAGACAGAAGGAGAAGAGGAAGTGGATCTGGAATTGGGAGGAGC
CTCCACCCACCCCTGACTCCTCCTTATGAAGCCAGCTGCTGAAATTAGCTACTCACCAAGAGT
GAGGGGCAGAGACTTCCAGTCACTGAGTCTCCCAGGCCCCTTGATCTGTACCCCACCCCTAT
CTAACACCACCCTTGGCTCCCACTCCAGCTCCCTGTATTGATATAACCTGTCAGGCTGGCTTG
GTTAGGTTTTACTGGGGCAGAGGATAGGGAATCTCTTATTAAAACTAACATGAAATATGTGTT
GTTTTCATTTGCAAATTTAAATAAAGATACATAATGTTTGTATGAAAAA
```

FIGURE 338

MISLPGPLVTNLLRFLFLGLSALAPPSRAQLQLHLPANRLQAVEGGEVVLPAWYTLHGEVSSS
QPWEVPFVMWFFKQKEKEDQVLSYINGVTTSKPGVSLVYSMPSRNLSLRLEGLQEKDSGPYSC
SVNVQDKQGKSRGHSIKTLELNVLVPPAPPSCRLQGVPHVGANVTLSCQSPRSKPAVQYQWDR
QLPSFQTFFAPALDVIRGSLSLTNLSSSMAGVYVCKAHNEVGTAQCNVTLEVSTGPGAAVVAG
AVVGTLVGLGLLAGLVLLYHRRGKALEEPANDIKEDAIAPRTLPWPKSSDTISKNGTLSSVTS
ARALRPPHGPPRPGALTPTPSLSSQALPSPRLPTTDGAHPQPISPIPGGVSSSGLSRMGAVPV
MVPAQSQAGSLV

Important features:

Signal peptide:

amino acids 1-29

Transmembrane domain:

amino acids 245-267

N-glycosylation site.

amino acids 108-112, 169-173, 213-217, 236-240, 307-311

N-myristoylation site.

amino acids 90-96, 167-173, 220-226, 231-237, 252-258, 256-262, 262-268, 308-314, 363-369, 364-370

Prokaryotic membrane lipoprotein lipid attachment site.

amino acids 164-175

FIGURE 339

```
GCGAGAACCTTTGCACGCGCACAAACTACGGGGACGATTTCTGATTGATTTTTGGCGCTTTCGATCCACCCTCCT
CCCTTCTCATGGGACTTTGGGGACAAAGCGTCCCGACCGCCTCGAGCGCTCGAGCAGGGCGCTATCCAGGAGCCA
GGACAGCGTCGGGAACCAGACCATGGCTCCTGGACCCCAAGATCCTTAAGTTCGTCGTCTTCATCGTCGCGGTTC
TGCTGCCGGTCCGGGTTGACTCTGCCACCATCCCCCGGCAGGACGAAGTTCCCCAGCAGACAGTGGCCCCACAGC
AACAGAGGCGCAGCCTCAAGGAGGAGGAGTGTCCAGCAGGATCTCATAGATCAGAATATACTGGAGCCTGTAACC
CGTGCACAGAGGGTGTGGATTACACCATTGCTTCCAACAATTTGCCTTCTTGCCTGCTATGTACAGTTTGTAAAT
CAGGTCAAACAAATAAAAGTTCCTGTACCACGACCAGAGACACCGTGTGTCAGTGTGAAAAAGGAAGCTTCCAGG
ATAAAAACTCCCCTGAGATGTGCCGGACGTGTAGAACAGGGTGTCCCAGAGGGATGGTCAAGGTCAGTAATTGTA
CGCCCCGGAGTGACATCAAGTGCAAAAATGAATCAGCTGCCAGTTCCACTGGGAAAACCCCAGCAGCGGAGGAGA
CAGTGACCACCATCCTGGGGATGCTTGCCTCTCCCTATCACTACCTTATCATCATAGTGGTTTTAGTCATCATTT
TAGCTGTGGTTGTGGTTGGCTTTTCATGTCGGAAGAAATTCATTTCTTACCTCAAAGGCATCTGCTCAGGTGGTG
GAGGAGGTCCCGAACGTGTGCACAGAGTCCTTTTCCGGCGGCGTTCATGTCCTTCACGAGTTCCTGGGGCGGAGG
ACAATGCCCGCAACGAGACCCTGAGTAACAGATACTTGCAGCCCACCCAGGTCTCTGAGCAGGAAATCCAAGGTC
AGGAGCTGGCAGAGCTAACAGGTGTGACTGTAGAGTCGCCAGAGGAGCCACAGCGTCTGCTGGAACAGGCAGAAG
CTGAAGGGTGTCAGAGGAGGAGGCTGCTGGTTCCAGTGAATGACGCTGACTCCGCTGACATCAGCACCTTGCTGG
ATGCCTCGGCAACACTGGAAGAAGGACATGCAAAGGAAACAATTCAGGACCAACTGGTGGGCTCCGAAAAGCTCT
TTTATGAAGAAGATGAGGCAGGCTCTGCTACGTCCTGCCTGTGAAAGAATCTCTTCAGGAAACCAGAGCTTCCCT
CATTTACCTTTTCTCCTACAAAGGGAAGCAGCCTGGAAGAAACAGTCCAGTACTTGACCCATGCCCCAACAAACT
CTACTATCCAATATGGGGCAGCTTACCAATGGTCCTAGAACTTTGTTAACGCACTTGGAGTAATTTTTATGAAAT
ACTGCGTGTGATAAGCAAACGGGAGAAATTTATATCAGATTCTTGGCTGCATAGTTATACGATTGTGTATTAAGG
GTCGTTTTAGGCCACATGCGGTGGCTCATGCCTGTAATCCCAGCACTTTGATAGGCTGAGGCAGGTGGATTGCTT
GAGCTCGGGAGTTTGAGACCAGCCTCATCAACACAGTGAAACTCCATCTCAATTTAAAAAGAAAAAAAGTGGTTT
TAGGATGTCATTCTTTGCAGTTCTTCATCATGAGACAAGTCTTTTTTTCTGCTTCTTATATTGCAAGCTCCATCT
CTACTGGTGTGTGCATTTAATGACATCTAACTACAGATGCCGCACAGCCACAATGCTTTGCCTTATAGTTTTTA
ACTTTAGAACGGGATTATCTTGTTATTACCTGTATTTTCAGTTTCGGATATTTTTGACTTAATGATGAGATTATC
AAGACGTAGCCCTATGCTAAGTCATGAGCATATGGACTTACGAGGGTTCGACTTAGAGTTTTGAGCTTTAAGATA
GGATTATTGGGGCTTACCCCCACCTTAATTAGAGAAACATTTATATTGCTTACTACTGTAGGCTGTACATCTCTT
TTCCGATTTTTGTATAATGATGTAAACATGGAAAAACTTTAGGAAATGCACTTATTAGGCTGTTTACATGGGTTG
CCTGGATACAAATCAGCAGTCAAAAATGACTAAAAATATAACTAGTGACGGAGGGAGAAATCCTCCCTCTGTGGG
AGGCACTTACTGCATTCCAGTTCTCCCTCCTGCGCCCTGAGACTGGACCAGGGTTTGATGGCTGGCAGCTTCTCA
AGGGGCAGCTTGTCTTACTTGTTAATTTTAGAGGTATATAGCCATATTTATTTATAAATAAATATTTATTTATTT
ATTTATAAGTAGATGTTTACATATGCCCAGGATTTTGAAGAGCCTGGTATCTTTGGGAAGCCATGTGTCTGGTTT
GTCGTGCTGGGACAGTCATGGGACTGCATCTTCCGACTTGTCCACAGCAGATGAGGACAGTGAGAATTAAGTTAG
ATCCGAGACTGCGAAGAGCTTCTCTTTCAAGCGCCATTACAGTTGAACGTTAGTGAATCTTGAGCCTCATTTGGG
CTCAGGGCAGAGCAGGTGTTTATCTGCCCCGGCATCTGCCATGGCATCAAGAGGGAAGAGTGGACGGTGCTTGGG
AATGGTGTGAAATGGTTGCCGACTCAGGCATGGATGGGCCCCTCTCGCTTCTGGTGGTCTGTGAACTGAGTCCCT
GGGATGCCTTTTAGGGCAGAGATTCCTGAGCTGCGTTTTAGGGTACAGATTCCCTGTTTGAGGAGCTTGGCCCCT
CTGTAAGCATCTGACTCATCTCAGAGATATCAATTCTTAAACACTGTGACAACGGGATCTAAAATGGCTGACACA
TTTGTCCTTGTGTCACGTTCCATTATTTTATTTAAAAACCTCAGTAATCGTTTTAGCTTCTTTCCAGCAAACTCT
TCTCCACAGTAGCCCAGTCGTGGTAGGATAAATTACGGATATAGTCATTCTAGGGGTTTCAGTCTTTTCCATCTC
AAGGCATTGTGTGTTTTGTTCCGGGACTGGTTTGGCTGGGACAAAGTTAGAACTGCCTGAAGTTCGCACATTCAG
ATTGTTGTGTCCATGGAGTTTTAGGAGGGGATGGCCTTTCCGGTCTTCGCACTTCCATCCTCTCCCACTTCCATC
TGGCGTCCCACACCTTGTCCCCTGCACTTCTGGATGACACAGGGTGCTGCTGCCTCCTAGTCTTTGCCTTTGCTG
GGCCTTCTGTGCAGGAGACTTGGTCTCAAAGCTCAGAGAGAGCCAGTCCGGTCCCAGCTCCTTTGTCCCTTCCTC
AGAGGCCTTCCTTGAAGATGCATCTAGACTACCAGCCTTATCAGTGTTTAAGCTTATTCCTTTAACATAAGCTTC
CTGACAACATGAAATTGTTGGGGTTTTTTGGCGTTGGTTGATTTGTTTAGGTTTTGCTTTATACCCGGGCCAAAT
AGCACATAACACCTGGTTATATATGAAATACTCATATGTTTATGACCAAAATAAATATGAAACCTCATRTTAAAA
AAAAAAAAAAAAAAAAAAAAAAAAAA
```

FIGURE 340

MGLWGQSVPTASSARAGRYPGARTASGTRPWLLDPKILKFVVFIVAVLLPVRVDSATIPRQDEVPQQTVAPQQQR
RSLKEEECPAGSHRSEYTGACNPCTEGVDYTIASNNLPSCLLCTVCKSGQTNKSSCTTTRDTVCQCEKGSFQDKN
SPEMCRTCRTGCPRGMVKVSNCTPRSDIKCKNESAASSTGKTPAAEETVTTILGMLASPYHYLIIIVVLVIILAV
VVVGFSCRKKFISYLKGICSGGGGGPERVHRVLFRRRSCPSRVPGAEDNARNETLSNRYLQPTQVSEQEIQGQEL
AELTGVTVESPEEPQRLLEQAEAEGCQRRRLLVPVNDADSADISTLLDASATLEEGHAKETIQDQLVGSEKLFYE
EDEAGSATSCL

Important features:
Transmembrane domains:
amino acids 35-52, 208-230

N-glycosylation sites.
amino acids 127-131, 182-186, 277-281

Glycosaminoglycan attachment site.
amino acids 245-249 cAMP- and cGMP-dependent protein kinase phosphorylation site.
amino acids 260-264

N-myristoylation sites.
amino acids 21-27, 86-92, 102-108, 161-167, 242-248, 270-276, 297-303, 380-386

ATP/GTP-binding site motif A (P-loop).
amino acids 185-193

TNFR/NGFR cysteine-rich region.
amino acids 99-139

FIGURE 341

```
GCCTCTGAATTGTTGGGCAGTCTGGCAGTGGAGCTCTCCCCGGTCTGACAGCCACTCCAGAGG
CCATGCTTCGTTTCTTGCCAGATTTGGCTTTCAGCTTCCTGTTAATTCTGGCTTTGGGCCAGG
CAGTCCAATTTCAAGAATATGTCTTTCTCCAATTTCTGGGCTTAGATAAGGCGCCTTCACCCC
AGAAGTTCCAACCTGTGCCTTATATCTTGAAGAAAATTTTCCAGGATCGCGAGGCAGCAGCGA
CCACTGGGGTCTCCCGAGACTTATGCTACGTAAAGGAGCTGGGCGTCCGCGGGAATGTACTTC
GCTTTCTCCCAGACCAAGGTTTCTTTCTTTACCCAAAGAAAATTTCCCAAGCTTCCTCCTGCC
TGCAGAAGCTCCTCTACTTTAACCTGTCTGCCATCAAAGAAAGGGAACAGTTGACATTGGCCC
AGCTGGGCCTGGACTTGGGGCCCAATTCTTACTATAACCTGGGACCAGAGCTGGAACTGGCTC
TGTTCCTGGTTCAGGAGCCTCATGTGTGGGGCCAGACCACCCCTAAGCCAGGTAAAATGTTTG
TGTTGCGGTCAGTCCCATGGCCACAAGGTGCTGTTCACTTCAACCTGCTGGATGTAGCTAAGG
ATTGGAATGACAACCCCCGGAAAAATTTCGGGTTATTCCTGGAGATACTGGTCAAAGAAGATA
GAGACTCAGGGGTGAATTTTCAGCCTGAAGACACCTGTGCCAGACTAAGATGCTCCCTTCATG
CTTCCCTGCTGGTGGTGACTCTCAACCCTGATCAGTGCCACCCTTCTCGGAAAAGGAGAGCAG
CCATCCCTGTCCCCAAGCTTTCTTGTAAGAACCTCTGCCACCGTCACCAGCTATTCATTAACT
TCCGGGACCTGGGTTGGCACAAGTGGATCATTGCCCCAAGGGGTTCATGGCAAATTACTGCC
ATGGAGAGTGTCCCTTCTCACTGACCATCTCTCTCAACAGCTCCAATTATGCTTTCATGCAAG
CCCTGATGCATGCCGTTGACCCAGAGATCCCCCAGGCTGTGTGTATCCCCACCAAGCTGTCTC
CCATTTCCATGCTCTACCAGGACAATAATGACAATGTCATTCTACGACATTATGAAGACATGG
TAGTCGATGAATGTGGGTGTGGGTAGGATGTCAGAAATGGGAATAGAAGGAGTGTTCTTAGGG
TAAATCTTTTAATAAAACTACCTATCTGGTTTATGACCACTTAGATCGAAATGTC
```

FIGURE 342

MLRFLPDLAFSFLLILALGQAVQFQEYVFLQFLGLDKAPSPQKFQPVPYILKKIFQDREAAAT
TGVSRDLCYVKELGVRGNVLRFLPDQGFFLYPKKISQASSCLQKLLYFNLSAIKEREQLTLAQ
LGLDLGPNSYYNLGPELELALFLVQEPHVWGQTTPKPGKMFVLRSVPWPQGAVHFNLLDVAKD
WNDNPRKNFGLFLEILVKEDRDSGVNFQPEDTCARLRCSLHASLLVVTLNPDQCHPSRKRRAA
IPVPKLSCKNLCHRHQLFINFRDLGWHKWIIAPKGFMANYCHGECPFSLTISLNSSNYAFMQA
LMHAVDPEIPQAVCIPTKLSPISMLYQDNNDNVILRHYEDMVVDECGCG

Important features:

Signal peptide:
amino acids 1-21

N-glycosylation sites.
amino acids 112-116, 306-310 cAMP- and cGMP-dependent protein kinase phosphorylation site.
amino acids 96-100

N-myristoylation site.
amino acids 77-83

TGF-beta family proteins.
amino acids 264-299, 327-341, 345-364

FIGURE 343

```
CCCACGCGTCCGGCCTTCTCTCTGGACTTTGCATTTCCATTCCTTTTCATTGACAAACTGACTTTTTTTATTTCT
TTTTTTCCATCTCTGGGCCAGCTTGGGATCCTAGGCCGCCCTGGGAAGACATTTGTGTTTTACACACATAAGGAT
CTGTGTTTGGGGTTTCTTCTTCCTCCCCTGACATTGGCATTGCTTAGTGGTTGTGTGGGGAGGGAGACCACGTGG
GCTCAGTGCTTGCTTGCACTTATCTGCCTAGGTACATCGAAGTCTTTTGACCTCCATACAGTGATTATGCCTGTC
ATCGCTGGTGGTATCCTGGCGGCCTTGCTCCTGCTGATAGTTGTCGTGCTCTGTCTTTACTTCAAAATACACAAC
GCGCTAAAAGCTGCAAAGGAACCTGAAGCTGTGGCTGTAAAAAATCACAACCCAGACAAGGTGTGGTGGGCCAAG
AACAGCCAGGCCAAAACCATTGCCACGGAGTCTTGTCCTGCCCTGCAGTGCTGTGAAGGATATAGAATGTGTGCC
AGTTTTGATTCCCTGCCACCTTGCTGTTGCGACATAAATGAGGGCCTCTGAGTTAGGAAAGGCTCCCTTCTCAAA
GCAGAGCCCTGAAGACTTCAATGATGTCAATGAGGCCACCTGTTTGTGATGTGCAGGCACAGAAGAAAGGCACAG
CTCCCCATCAGTTTCATGGAAAATAACTCAGTGCCTGCTGGGAACCAGCTGCTGGAGATCCCTACAGAGAGCTTC
CACTGGGGGCAACCCTTCCAGGAAGGAGTTGGGGAGAGAGAACCCTCACTGTGGGGAATGCTGATAAACCAGTCA
CACAGCTGCTCTATTCTCACACAAATCTACCCCTTGCGTGGCTGGAACTGACGTTTCCCTGGAGGTGTCCAGAAA
GCTGATGTAACACAGAGCCTATAAAAGCTGTCGGTCCTTAAGGCTGCCCAGCGCCTTGCCAAAATGGAGCTTGTA
AGAAGGCTCATGCCATTGACCCTCTTAATTCTCTCCTGTTTGGCGGAGCTGACAATGGCGGAGGCTGAAGGCAAT
GCAAGCTGCACAGTCAGTCTAGGGGGTGCCAATATGGCAGAGACCCACAAAGCCATGATCCTGCAACTCAATCCC
AGTGAGAACTGCACCTGGACAATAGAAAGACCAGAAAACAAAAGCATCAGAATTATCTTTTCCTATGTCCAGCTT
GATCCAGATGGAAGCTGTGAAAGTGAAAACATTAAAGTCTTTGACGGAACCTCCAGCAATGGGCCTCTGCTAGGG
CAAGTCTGCAGTAAAAACGACTATGTTCCTGTATTTGAATCATCATCCAGTACATTGACGTTTCAAATAGTTACT
GACTCAGCAAGAATTCAAAGAACTGTCTTTGTCTTCTACTACTTCTTCTCTCCTAACATCTCTATTCCAAACTGT
GGCGGTTACCTGGATACCTTGGAAGGATCCTTCACCAGCCCCAATTACCCAAAGCCGCATCCTGAGCTGGCTTAT
TGTGTGTGGCACATACAAGTGGAGAAAGATTACAAGATAAAACTAAACTTCAAAGAGATTTTCCTAGAAATAGAC
AAACAGTGCAAATTTGATTTTCTTGCCATCTATGATGGCCCCTCCACCAACTCTGGCCTGATTGGACAAGTCTGT
GGCCGTGTGACTCCCACCTTCGAATCGTCATCAAACTCTCTGACTGTCGTGTTGTCTACAGATTATGCCAATTCT
TACCGGGGATTTTCTGCTTCCTACACCTCAATTTATGCAGAAAACATCAACACTACATCTTTAACTTGCTCTTCT
GACAGGATGAGAGTTATTATAAGCAAATCCTACCTAGAGGCTTTTAACTCTAATGGGAATAACTTGCAACTAAAA
GACCCAACTTGCAGACCAAAATTATCAAATGTTGTGGAATTTTCTGTCCCTCTTAATGGATGTGGTACAATCAGA
AAGGTAGAAGATCAGTCAATTACTTACACCAATATAATCACCTTTTCTGCATCCTCAACTTCTGAAGTGATCACC
CGTCAGAAACAACTCCAGATTATTGTGAAGTGTGAAATGGGACATAATTCTACAGTGGAGATAATATACATAACA
GAAGATGATGTAATACAAAGTCAAAATGCACTGGGCAAATATAACACCAGCATGGCTCTTTTGAATCCAATTCA
TTTGAAAAGACTATACTTGAATCACCATATTATGTGGATTTGAACCAAACTCTTTTTGTTCAAGTTAGTCTGCAC
ACCTCAGATCCAAATTTGGTGGTGTTTCTTGATACCTGTAGAGCCTCTCCCACCTCTGACTTTGCATCTCCAACC
TACGACCTAATCAAGAGTGGATGTAGTCGAGATGAAACTTGTAAGGTGTATCCCTTATTTGGACACTATGGGAGA
TTCCAGTTTAATGCCTTTAAATTCTTGAGAAGTATGAGCTCTGTGTATCTGCAGTGTAAAGTTTTGATATGTGAT
AGCAGTGACCACCAGTCTCGCTGCAATCAAGGTTGTGTCTCCAGAAGCAAACGAGACATTTCTTCATATAAATGG
AAAACAGATTCCATCATAGGACCCATTCGTCTGAAAAGGGATCGAAGTGCAAGTGGCAATTCAGGATTTCAGCAT
GAAACACATGCGGAAGAAACTCCAAACCAGCCTTTCAACAGTGTGCATCTGTTTTCCTTCATGGTTCTAGCTCTG
AATGTGGTGACTGTAGCGACAATCACAGTGAGGCATTTTGTAAATCAACGGGCAGACTACAAATACCAGAAGCTG
CAGAACTATTAACTAACAGGTCCAACCCTAAGTGAGACATGTTTCTCCAGGATGCCAAAGGAAATGCTACCTCGT
GGCTACACATATTATGAATAAATGAGGAAGGGCCTGAAAGTGACACACAGGCCTGCATGTAAAAAAA
```

FIGURE 344

MELVRRLMPLTLLILSCLAELTMAEAEGNASCTVSLGGANMAETHKAMILQLNPSENCTWTIE
RPENKSIRIIFSYVQLDPDGSCESENIKVFDGTSSNGPLLGQVCSKNDYVPVFESSSSTLTFQ
IVTDSARIQRTVFVFYYFFSPNISIPNCGGYLDTLEGSFTSPNYPKPHPELAYCVWHIQVEKD
YKIKLNFKEIFLEIDKQCKFDFLAIYDGPSTNSGLIGQVCGRVTPTFESSSNSLTVVLSTDYA
NSYRGFSASYTSIYAENINTTSLTCSSDRMRVIISKSYLEAFNSNGNNLQLKDPTCRPKLSNV
VEFSVPLNGCGTIRKVEDQSITYTNIITFSASSTSEVITRQKQLQIIVKCEMGHNSTVEIIYI
TEDDVIQSQNALGKYNTSMALFESNSFEKTILESPYYVDLNQTLFVQVSLHTSDPNLVVFLDT
CRASPTSDFASPTYDLIKSGCSRDETCKVYPLFGHYGRFQFNAFKFLRSMSSVYLQCKVLICD
SSDHQSRCNQGCVSRSKRDISSYKWKTDSIIGPIRLKRDRSASGNSGFQHETHAEETPNQPFN
SVHLFSFMVLALNVVTVATITVRHFVNQRADYKYQKLQNY

Important features:
Signal sequence:
amino acids 1-24

Transmembrane domain:
amino acids 571-586

N-glycosylation site.
amino acids 29-33, 57-61, 67-71, 148-152, 271-275, 370-374, 394-398, 419-423

Casein kinase II phosphorylation site.
amino acids 22-26, 108-112, 289-293, 348-352, 371-375, 379-383, 408-412, 463-467, 520-524, 556-560

Tyrosine kinase phosphorylation site.
amino acids 172-180, 407-415, 407-416, 519-528

N-myristoylation site.
amino acids 28-34, 38-44, 83-89, 95-101, 104-110, 226-232

Prokaryotic membrane lipoprotein lipid attachment site.
amino acids 7-18

FIGURE 345

```
TGGGGGCCCCCCAGGCTCGCGCGTGGAGCGAAGCAGCATGGGCAGTCGGTGCGCGCTGGCCCTGGCGGTGCTCTC
GGCCTTGCTGTGTCAGGTCTGGAGCTCTGGGGTGTTCGAACTGAAGCTGCAGGAGTTCGTCAACAAGAAGGGGCT
GCTGGGGAACCGCAATTGCTGCCGCGGGGGCGCGGGGCCACCGCCGTGCGCCTGCCGGACCTTCTTCCGCGTGTG
CCTCAAGCACTACCAGGCCAGCGTGTCCCCCGAGCCGCCCTGCACCTACGGCAGCGCCGTCACCCCCGTGCTGGG
CGTCGACTCCTTCAGTCTGCCCGACGGCGGGGGCGCCGACTCCGCGTTCAGCAACCCCATCCGCTTCCCCTTCGG
CTTCACCTGGCCGGGCACCTTCTCTCTGATTATTGAAGCTCTCCACACAGATTCTCCTGATGACCTCGCAACAGA
AAACCCAGAAAGACTCATCAGCCGCCTGGCCACCCAGAGGCACCTGACGGTGGGCGAGGAGTGGTCCCAGGACCT
GCACAGCAGCGGCCGCACGGACCTCAAGTACTCCTACCGCTTCGTGTGTGACGAACACTACTACGGAGAGGGCTG
CTCCGTTTTCTGCCGTCCCCGGGACGATGCCTTCGGCCACTTCACCTGTGGGGAGCGTGGGGAGAAAGTGTGCAA
CCCTGGCTGGAAAGGGCCCTACTGCACAGAGCCGATCTGCCTGCCTGGATGTGATGAGCAGCATGGATTTTGTGA
CAAACCAGGGGAATGCAAGTGCAGAGTGGGCTGGCAGGGCCGGTACTGTGACGAGTGTATCCGCTATCCAGGCTG
TCTCCATGGCACCTGCCAGCAGCCCTGGCAGTGCAACTGCCAGGAAGGCTGGGGGGGCCTTTTCTGCAACCAGGA
CCTGAACTACTGCACACACCATAAGCCCTGCAAGAATGGAGCCACCTGCACCAACACGGGCCAGGGAGCTACAC
TTGCTCTTGCCGGCCTGGGTACACAGGTGCCACCTGCGAGCTGGGGATTGACGAGTGTGACCCCAGCCCTTGTAA
GAACGGAGGGAGCTGCACGGATCTCGAGAACAGCTACTCCTGTACCTGCCCACCCGGCTTCTACGGCAAAATCTG
TGAATTGAGTGCCATGACCTGTGCGGACGGCCCTTGCTTTAACGGGGGTCGGTGCTCAGACAGCCCCGATGGAGG
GTACAGCTGCCGCTGCCCCGTGGGCTACTCCGGCTTCAACTGTGAGAAGAAAATTGACTACTGCAGCTCTTCACC
CTGTTCTAATGGTGCCAAGTGTGTGGACCTCGGTGATGCCTACCTGTGCCGCTGCCAGGCCGGCTTCTCGGGGAG
GCACTGTGACGACAACGTGGACGACTGCGCCTCCTCCCCGTGCGCCAACGGGGGCACCTGCCGGGATGGCGTGAA
CGACTTCTCCTGCACCTGCCCGCCTGGCTACACGGGCAGGAACTGCAGTGCCCCCGTCAGCAGGTGCGAGCACGC
ACCCTGCCACAATGGGGCCACCTGCCACGAGAGGGGCCACCGCTATGTGTGCGAGTGTGCCCGAGGCTACGGGGG
TCCCAACTGCCAGTTCCTGCTCCCCGAGCTGCCCCGGGCCAGCGGTGGTGGACCTCACTGAGAAGCTAGAGGG
CCAGGGCGGGCCATTCCCCTGGGTGGCCGTGTGCGCCGGGGTCATCCTTGTCCTCATGCTGCTGCTGGGCTGTGC
CGCTGTGGTGGTCTGCGTCCGGCTGAGGCTGCAGAAGCACCGGCCCCAGCCGACCCCTGCCGGGGGAGACGGA
GACCATGAACAACCTGGCCAACTGCCAGCGTGAGAAGGACATCTCAGTCAGCATCATCGGGGCCACGCAGATCAA
GAACACCAACAAGAAGGCGGACTTCCACGGGGACCACAGCGCCGACAAGAATGGCTTCAAGGCCCGCTACCCAGC
GGTGGACTATAACCTCGTGCAGGACCTCAAGGGTGACGACACCGCGTCAGGGACGCGCACAGCAAGCGTGACAC
CAAGTGCCAGCCCCAGGGCTCCTCAGGGGAGGAGAAGGGGACCCCGACCACACTCAGGGGTGGAGAAGCATCTGA
AGAAAAAGGCCGGACTCGGGCTGTTCAACTTCAAAAGACACCAAGTACCAGTCGGTGTACGTCATATCCGAGGA
GAAGGATGAGTGCGTCATAGCAACTGAGGTGTAAAATGGAAGTGAGATGGCAAGACTCCCGTTTCTCTTAAAATA
AGTAAAATTCCAAGGATATATGCCCCAACGAATGCTGCTGAAGAGGAGGGAGGCCTCGTGGACTGCTGCTGAGAA
ACCGAGTTCAGACCGAGCAGGTTCTCCTCCTGAGGTCCTCGACGCCTGCCGACAGCCTGTCGCGGCCCGGCCGCC
TGCGGCACTGCCTTCCGTGACGTCGCCGTTGCACTATGGACAGTTGCTCTTAAGAGAATATATATTTAAATGGGT
GAACTGAATTACGCATAAGAAGCATGCACTGCCTGAGTGTATATTTTGGATTCTTATGAGCCAGTCTTTTCTTGA
ATTAGAAACACAAACACTGCCTTTATTGTCCTTTTTGATACGAAGATGTGCTTTTTCTAGATGGAAAAGATGTGT
GTTATTTTTTGGATTTGTAAAAATATTTTTCATGATATCTGTAAAGCTTGAGTATTTTGTGATGTTCGTTTTTTA
TAATTTAAATTTTGGTAAATATGTACAAAGGCACTTCGGGTCTATGTGACTATATTTTTTTGTATATAAATGTAT
TTATGGAATATTGTGCAAATGTTATTTGAGTTTTTTACTGTTTTGTTAATGAAGAAATTCCTTTTTAAAATATTT
TTCCAAAATAAATTTTATGAATGACAAAAAAAAAAAAAAAAAAAAAAAAAAAAAAAAAAAAAAAAAAAAAAAAAAA
AAAAAAAA
```

FIGURE 346

MGSRCALALAVLSALLCQVWSSGVFELKLQEFVNKKGLLGNRNCCRGGAGPPPCACRTFFRVC
LKHYQASVSPEPPCTYGSAVTPVLGVDSFSLPDGGGADSAFSNPIRFPFGFTWPGTFSLIIEA
LHTDSPDDLATENPERLISRLATQRHLTVGEEWSQDLHSSGRTDLKYSYRFVCDEHYYGEGCS
VFCRPRDDAFGHFTCGERGEKVCNPGWKGPYCTEPICLPGCDEQHGFCDKPGECKCRVGWQGR
YCDECIRYPGCLHGTCQQPWQCNCQEGWGGLFCNQDLNYCTHHKPCKNGATCTNTGQGSYTCS
CRPGYTGATCELGIDECDPSPCKNGGSCTDLENSYSCTCPPGFYGKICELSAMTCADGPCFNG
GRCSDSPDGGYSCRCPVGYSGFNCEKKIDYCSSSPCSNGAKCVDLGDAYLCRCQAGFSGRHCD
DNVDDCASSPCANGGTCRDGVNDFSCTCPPGYTGRNCSAPVSRCEHAPCHNGATCHERGHRYV
CECARGYGGPNCQFLLPELPPGPAVVDLTEKLEGQGGPFPWVAVCAGVILVLMLLLGCAAVVV
CVRLRLQKHRPPADPCRGETETMNNLANCQREKDISVSIIGATQIKNTNKKADFHGDHSADKN
GFKARYPAVDYNLVQDLKGDDTAVRDAHSKRDTKCQPQGSSGEEKGTPTTLRGGEASERKRPD
SGCSTSKDTKYQSVYVISEEKDECVIATEV

Important features:
Signal sequence:
Amino acids 1-21

Transmembrane domain:
Amino acids 546-566

N-glycosylation site:
Amino acids 477-481 cAMP- and cGMP-dependent protein kinase phosphorylation site:
Amino acids 660-664

Tyrosine kinase phosphorylation sites:
Amino acids 176-185;252-261

N-myristoylation sites:
Amino acids 2-8;37-43;40-46;98-104;99-105;262-268;281-287;
282-288;301-307;310-316;328-334;340-344;378-384;387-393;512-518;
676-682;683-689;695-701

Aspartic acid and asparagine hydroxylation sites:
Amino acids 343-355;420-432;458-470

Prokaryotic membrane lipoprotein lipid attachment site:
Amino acids 552-563

EGF-like domain cysteine pattern signature:
Amino acids 243-255;274-286;314-326;352-364;391-403;429-441;
467-479;505-517

FIGURE 347

CCCACGCGTCCGCACCTCGGCCCCGGGCTCCGAAGCGGCTCGGGGGCGCCCTTTCGGTCAACA
TCGTAGTCCACCCCCTCCCCATCCCCAGCCCCGGGGATTCAGGCTCGCCAGCGCCCAGCCAG
GGAGCCGGCCGGGAAGCGCG<u>ATG</u>GGGGCCCCAGCCGCCTCGCTCCTGCTCCTGCTCCTGCTGT
TCGCCTGCTGCTGGGCGCCCGGCGGGCCAACCTCTCCCAGGACGACAGCCAGCCCTGGACAT
CTGATGAAACAGTGGTGGCTGGTGGCACCGTGGTGCTCAAGTGCCAAGTGAAAGATCACGAGG
ACTCATCCCTGCAATGGTCTAACCCTGCTCAGCAGACTCTCTACTTTGGGGAGAAGAGAGCCC
TTCGAGATAATCGAATTCAGCTGGTTACCTCTACGCCCACGAGCTCAGCATCAGCATCAGCA
ATGTGGCCCTGGCAGACGAGGGCGAGTACACCTGCTCAATCTTCACTATGCCTGTGCGAACTG
CCAAGTCCCTCGTCACTGTGCTAGGAATTCCACAGAAGCCCATCATCACTGGTTATAAATCTT
CATTACGGGAAAAAGACACAGCCACCCTAAACTGTCAGTCTTCTGGGAGCAAGCCTGCAGCCC
GGCTCACCTGGAGAAAGGGTGACCAAGAACTCCACGGAGAACCAACCCGCATACAGGAAGATC
CCAATGGTAAAACCTTCACTGTCAGCAGCTCGGTGACATTCCAGGTTACCCGGGAGGATGATG
GGGCGAGCATCGTGTGCTCTGTGAACCATGAATCTCTAAAGGGAGCTGACAGATCCACCTCTC
AACGCATTGAAGTTTTATACACACCAACTGCGATGATTAGGCCAGACCCTCCCCATCCTCGTG
AGGGCCAGAAGCTGTTGCTACACTGTGAGGGTCGCGGCAATCCAGTCCCCAGCAGTACCTAT
GGGAGAAGGAGGGCAGTGTGCCACCCCTGAAGATGACCCAGGAGAGTGCCCTGATCTTCCCTT
TCCTCAACAAGAGTGACAGTGGCACCTACGGCTGCACAGCCACCAGCAACATGGGCAGCTACA
AGGCCTACTACACCCTCAATGTTAATGACCCCAGTCCGGTGCCCTCCTCCTCCAGCACCTACC
ACGCCATCATCGGTGGGATCGTGGCTTTCATTGTCTTCCTGCTGCTCATCATGCTCATCTTCC
TTGGCCACTACTTGATCCGGCACAAAGGAACCTACCTGACACATGAGGCAAAAGGCTCCGACG
ATGCTCCAGACGCGGACACGGCCATCATCAATGCAGAAGGCGGGCAGTCAGGAGGGACGACA
AGAAGGAATATTTCATC<u>TAG</u>AGGCGCCTGCCCACTTCCTGCGCCCCCAGGGGCCCTGTGGGG
ACTGCTGGGGCCGTCACCAACCCGGACTTGTACAGAGCAACCGCAGGGCCGCCCCTCCCGCTT
GCTCCCCAGCCCACCCACCCCCTGTACAGAATGTCTGCTTTGGGTGCGGTTTTGTACTCGGT
TTGGAATGGGGAGGGAGGAGGGCGGGGGAGGGGAGGGTTGCCCTCAGCCCTTTCCGTGGCTT
CTCTGCATTTGGGTTATTATTATTTTGTAACAATCCCAAATCAAATCTGTCTCCAGGCTGGA
GAGGCAGGAGCCCTGGGGTGAGAAAAGCAAAAAACAAACAAAAAACA

FIGURE 348

MGAPAASLLLLLLLLFACCWAPGGANLSQDDSQPWTSDETVVAGGTVVLKCQVKDHEDSSLQWS
NPAQQTLYFGEKRALRDNRIQLVTSTPHELSISISNVALADEGEYTCSIFTMPVRTAKSLVTV
LGIPQKPIITGYKSSLREKDTATLNCQSSGSKPAARLTWRKGDQELHGEPTRIQEDPNGKTFT
VSSSVTFQVTREDDGASIVCSVNHESLKGADRSTSQRIEVLYTPTAMIRPDPPHPREGQKLLL
HCEGRGNPVPQQYLWEKEGSVPPLKMTQESALIFPFLNKSDSGTYGCTATSNMGSYKAYYTLN
VNDPSPVPSSSSTYHAIIGGIVAFIVFLLLIMLIFLGHYLIRHKGTYLTHEAKGSDDAPDADT
AIINAEGGQSGGDDKKEYFI

Important features:
Signal sequence:
amino acids 1-20

Transmembrane domain:
amino acids 331-352

N-glycosylation site.
amino acids 25-29, 290-294

Casein kinase II phosphorylation site.
amino acids 27-31, 35-39, 89-93, 141-145, 199-203, 388-392

N-myristoylation site.
amino acids 2-8, 23-29, 156-162, 218-224, 295-301, 298-304, 306-310, 334-340, 360-364, 385-389, 386-390

Prokaryotic membrane lipoprotein lipid attachment site.
amino acids 7-18

FIGURE 349

```
ACTTGCCATCACCTGTTGCCAGTGTGGAAAAATTCTCCCTGTTGAATTTTTTGCACATGGAGGACAGCAGCAAAG
AGGGCAACACAGGCTGATAAGACCAGAGACAGCAGGGAGATTATTTTACCATACGCCCTCAGGACGTTCCCTCTA
GCTGGAGTTCTGGACTTCAACAGAACCCCATCCAGTCATTTTGATTTGCTGTTTATTTTTTTTTCTTTTTCTT
TTTCCCACCACATTGTATTTTATTTCCGTACTTCAGAAATGGGCCTACAGACCACAAAGTGGCCCAGCCATGGGG
CTTTTTTCCTGAAGTCTTGGCTTATCATTTCCCTGGGGCTCTACTCACAGGTGTCCAAACTCCTGGCCTGCCCTA
GTGTGTGCCGCTGCGACAGGAACTTTGTCTACTGTAATGAGCGAAGCTTGACCTCAGTGCCTCTTGGGATCCCGG
AGGGCGTAACCGTACTCTACCTCCACAACAACCAAATTAATAATGCTGGATTTCCTGCAGAACTGCACAATGTAC
AGTCGGTGCACACGGTCTACCTGTATGGCAACCAACTGGACGAATTCCCCATGAACCTTCCCAAGAATGTCAGAG
TTCTCCATTTGCAGGAAAACAATATTCAGACCATTTCACGGGCTGCTCTTGCCCAGCTCTTGAAGCTTGAAGAGC
TGCACCTGGATGACAACTCCATATCCACAGTGGGGGTGGAAGACGGGGCCTTCCGGGAGGCTATTAGCCTCAAAT
TGTTGTTTTGTCTAAGAATCACCTGAGCAGTGTGCCTGTTGGGCTTCCTGTGGACTTGCAAGAGCTGAGAGTGG
ATGAAAATCGAATTGCTGTCATATCCGACATGGCCTTCCAGAATCTCACGAGCTTGGAGCGTCTTATTGTGGACG
GGAACCTCCTGACCAACAAGGGTATCGCCGAGGGCACCTTCAGCCATCTCACCAAGCTCAAGGAATTTTCAATTG
TACGTAATTCGCTGTCCCACCCTCCTCCCGATCTCCCAGGTACGCATCTGATCAGGCTCTATTTGCAGGACAACC
AGATAAACCACATTCCTTTGACAGCCTTCTCAAATCTGCGTAAGCTGGAACGGCTGGATATATCCAACAACCAAC
TGCGGATGCTGACTCAAGGGGTTTTTGATAATCTCTCCAACCTGAAGCAGCTCACTGCTCGGAATAACCCTTGGT
TTTGTGACTGCAGTATTAAATGGGTCACAGAATGGCTCAAATATATCCCTTCATCTCTCAACGTGCGGGGTTTCA
TGTGCCAAGGTCCTGAACAAGTCCGGGGGATGGCCGTCAGGGAATTAAATATGAATCTTTTGTCCTGTCCCACCA
CGACCCCCGGCCTGCCTCTCTTCACCCCAGCCCCAAGTACAGCTTCTCCGACCACTCAGCCTCCCACCCTCTCTA
TTCCAAACCCTAGCAGAAGCTACACGCCTCCAACTCCTACCACATCGAAACTTCCCACGATTCCTGACTGGGATG
GCAGAGAAAGAGTGACCCCACCTATTTCTGAACGGATCCAGCTCTCTATCCATTTTGTGAATGATACTTCCATTC
AAGTCAGCTGGCTCTCTCTCTTCACCGTGATGGCATACAAACTCACATGGGTGAAAATGGGCCACAGTTTAGTAG
GGGGCATCGTTCAGGAGCGCATAGTCAGCGGTGAGAAGCAACACCTGAGCCTGGTTAACTTAGAGCCCCGATCCA
CCTATCGGATTTGTTTAGTGCCACTGGATGCTTTTAACTACCGCGCGGTAGAAGACACCATTTGTTCAGAGGCCA
CCACCCATGCCTCCTATCTGAACAACGGCAGCAACACAGCGTCCAGCCATGAGCAGACGACGTCCCACAGCATGG
GCTCCCCCTTTCTGCTGGCGGGCTTGATCGGGGGCGCGGTGATATTTGTGCTGGTGGTCTTGCTCAGCGTCTTTT
GCTGGCATATGCACAAAAAGGGGCGCTACACCTCCCAGAAGTGGAAATACAACCGGGGCCGGCGGAAAGATGATT
ATTGCGAGGCAGGCACCAAGAAGGACAACTCCATCCTGGAGATGACAGAAACCAGTTTTCAGATCGTCTCCTTAA
ATAACGATCAACTCCTTAAAGGAGATTTCAGACTGCAGCCCATTTACACCCCAAATGGGGCATTAATTACACAG
ACTGCCATATCCCCAACAACATGCGATACTGCAACAGCAGCGTGCCAGACCTGGAGCACTGCCATACGTGACAGC
CAGAGGCCCAGCGTTATCAAGGCGGACAATTAGACTCTTGAGAACACACTCGTGTGTGCACATAAAGACACGCAG
ATTACATTTGATAAATGTTACACAGATGCATTTGTGCATTTGAATACTCTGTAATTTATACGGTGTACTATATAA
TGGGATTTAAAAAAAGTGCTATCTTTTCTATTTCAAGTTAATTACAAACAGTTTTGTAACTCTTTGCTTTTTAAA
TCTT
```

FIGURE 350

MGLQTTKWPSHGAFFLKSWLIISLGLYSQVSKLLACPSVCRCDRNFVYCNERSLTSVPLGIPE
GVTVLYLHNNQINNAGFPAELHNVQSVHTVYLYGNQLDEFPMNLPKNVRVLHLQENNIQTISR
AALAQLLKLEELHLDDNSISTVGVEDGAFREAISLKLLFLSKNHLSSVPVGLPVDLQELRVDE
NRIAVISDMAFQNLTSLERLIVDGNLLTNKGIAEGTFSHLTKLKEFSIVRNSLSHPPPDLPGT
HLIRLYLQDNQINHIPLTAFSNLRKLERLDISNNQLRMLTQGVFDNLSNLKQLTARNNPWFCD
CSIKWVTEWLKYIPSSLNVRGFMCQGPEQVRGMAVRELNMNLLSCPTTTPGLPLFTPAPSTAS
PTTQPPTLSIPNPSRSYTPPTPTTSKLPTIPDWDGRERVTPPISERIQLSIHFVNDTSIQVSW
LSLFTVMAYKLTWVKMGHSLVGGIVQERIVSGEKQHLSLVNLEPRSTYRICLVPLDAFNYRAV
EDTICSEATTHASYLNNGSNTASSHEQTTSHSMGSPFLLAGLIGGAVIFVLVVLLSVFCWHMH
KKGRYTSQKWKYNRGRRKDDYCEAGTKKDNSILEMTETSFQIVSLNNDQLLKGDFRLQPIYTP
NGGINYTDCHIPNNMRYCNSSVPDLEHCHT

Important features:

Signal peptide:

amino acids 1-42

Transmembrane domain:

amino acids 542-561

N-glycosylation site.

amino acids 202-206, 298-302, 433-437, 521-525, 635-639, 649-653

Casein kinase II phosphorylation site.

amino acids 204-208, 407-411, 527-531, 593-597, 598-602, 651-655

Tyrosine kinase phosphorylation site.

amino acids 319-328

N-myristoylation site.

amino acids 2-8, 60-66, 149-155, 213-219, 220-226, 294-300, 522-528, 545-551, 633-639

Amidation site.

amino acids 581-585

Leucine zipper pattern.

amino acids 164-186

Phospholipase A2 aspartic acid active site.

amino acids 39-50

FIGURE 351

```
AGCCGACGCTGCTCAAGCTGCAACTCTGTTGCAGTTGGCAGTTCTTTTCGGTTTCCCTCCTGCTGTTTGGGGGCA
TGAAAGGGCTTCGCCGCCGGGAGTAAAAGAAGGAATTGACCGGGCAGCGCGAGGGAGGAGCGCGCACGCGACCGC
GAGGGCGGGCGTGCACCCTCGGCTGGAAGTTTGTGCCGGGCCCCGAGCGCGCGCCGGCTGGGAGCTTCGGGTAGA
GACCTAGGCCGCTGGACCGCGATGAGCGCGCCGAGCCTCCGTGCGCGCGCCGCGGGGTTGGGGCTGCTGCTGTGC
GCGGTGCTGGGGCGCGCTGGCCGGTCCGACAGCGGCGGTCGCGGGGAACTCGGGCAGCCCTCTGGGGTAGCCGCC
GAGCGCCCATGCCCCACTACCTGCCGCTGCCTCGGGGACCTGCTGGACTGCAGTCGTAAGCGGCTAGCGCGTCTT
CCCGAGCCACTCCCGTCCTGGGTCGCTCGGCTGGACTTAAGTCACAACAGATTATCTTTCATCAAGGCAAGTTCC
ATGAGCCACCTTCAAAGCCTTCGAGAAGTGAAACTGAACAACAATGAATTGGAGACCATTCCAAATCTGGGACCA
GTCTCGGCAAATATTACACTTCTCTCCTTGGCTGGAAACAGGATTGTTGAAATACTCCCTGAACATCTGAAAGAG
TTTCAGTCCCTTGAAACTTTGGACCTTAGCAGCAACAATATTTCAGAGCTCCAAACTGCATTTCCAGCCCTACAG
CTCAAATATCTGTATCTCAACAGCAACCGAGTCACATCAATGGAACCTGGGTATTTTGACAATTTGGCCAACACA
CTCCTTGTGTTAAAGCTGAACAGGAACCGAATCTCAGCTATCCCACCCAAGATGTTTAAACTGCCCCAACTGCAA
CATCTCGAATTGAACCGAAACAAGATTAAAAATGTAGATGGACTGACATTCCAAGGCCTTGGTGCTCTGAAGTCT
CTGAAAATGCAAAGAAATGGAGTAACGAAACTTATGGATGGAGCTTTTGGGGGCTGAGCAACATGGAAATTTTG
CAGCTGGACCATAACAACCTAACAGAGATTACCAAAGGCTGGCTTTACGGCTTGCTGATGCTGCAGGAACTTCAT
CTCAGCCAAAATGCCATCAACAGGATCAGCCCTGATGCCTGGGAGTTCTGCCAGAAGCTCAGTGAGCTGGACCTA
ACTTTCAATCACTTATCAAGGTTAGATGATTCAAGCTTCCTTGGCCTAAGCTTACTAAATACACTGCACATTGGG
AACAACAGAGTCAGCTACATTGCTGATTGTGCCTTCCGGGGCTTTCCAGTTTAAAGACTTTGGATCTGAAGAAC
AATGAAATTTCCTGGACTATTGAAGACATGAATGGTGCTTTCTCTGGGCTTGACAAACTGAGGCGACTGATACTC
CAAGGAAATCGGATCCGTTCTATTACTAAAAAGCCTTCACTGGTTTGGATGCATTGGAGCATCTAGACCTGAGT
GACAACGCAATCATGTCTTTACAAGGCAATGCATTTTCACAAATGAAGAAACTGCAACAATTGCATTTAAATACA
TCAAGCCTTTTGTGCGATTGCCAGCTAAAATGGCTCCCACAGTGGGTGGCGGAAAACAACTTTCAGAGCTTTGTA
AATGCCAGTTGTGCCCATCCTCAGCTGCTAAAAGGAAGAAGCATTTTGCTGTTAGCCCAGATGGCTTTGTGTGT
GATGATTTTCCCAAACCCCAGATCACGGTTCAGCCAGAAACACAGTCGGCAATAAAAGGTTCCAATTTGAGTTTC
ATCTGCTCAGCTGCCAGCAGCAGTGATTCCCCAATGACTTTTGCTTGGAAAAAAGACAATGAACTACTGCATGAT
GCTGAAATGGAAAATTATGCACACCTCCGGGCCCAAGGTGGCGAGGTGATGGAGTATACCACCATCCTTCGGCTG
CGCGAGGTGGAATTTGCCAGTGAGGGGAAATATCAGTGTGTCATCTCCAATCACTTTGGTTCATCCTACTCTGTC
AAAGCCAAGCTTACAGTAAATATGCTTCCCTCATTCACCAAGACCCCCATGGATCTCACCATCCGAGCTGGGGCC
ATGGCACGCTTGGAGTGTGCTGCTGTGGGGCACCCAGCCCCCAGATAGCCTGGCAGAAGGATGGGGCACAGAC
TTCCCAGCTGCACGGGAGAGACGCATGCATGTGATGCCCGAGGATGACGTGTTCTTTATCGTGGATGTGAAGATA
GAGGACATTGGGGTATACAGCTGCACAGCTCAGAACAGTGCAGGAAGTATTTCAGCAAATGCAACTCTGACTGTC
CTAGAAACACCATCATTTTTGCGGCCACTGTTGGACCGAACTGTAACCAAGGGAGAAACAGCCGTCCTACAGTGC
ATTGCTGGAGGAAGCCCTCCCCCTAAACTGAACTGGACCAAAGATGATAGCCCATTGGTGGTAACCGAGAGGCAC
TTTTTTGCAGCAGGCAATCAGCTTCTGATTATTGTGGACTCAGATGTCAGTGATGCTGGGAAATACACATGTGAG
ATGTCTAACACCCTTGGCACTGAGAGAGGAAACGTGCGCCTCAGTGTGATCCCCACTCCAACCTGCGACTCCCCT
CAGATGACAGCCCCATCGTTAGACGATGACGGATGGGCCACTGTGGGTGTCGTGATCATAGCCGTGGTTTGCTGT
GTGGTGGGCACGTCACTCGTGTGGGTGGTCATCATATACCACACAAGGCGGAGGAATGAAGATTGCAGCATTACC
AACACAGATGAGACCAACTTGCCAGCAGATATTCCTAGTTATTTGTCATCTCAGGGAACGTTAGCTGACAGGCAG
GATGGGTACGTCGTCTTCAGAAAGTGGAAGCCACCACCAGTTTGTCACATCTTCAGGTGCTGGATTTTTCTTACCA
CAACATGACAGTAGTGGGACCTGCCATATTGACAATAGCAGTGAAGCTGATGTGGAAGCTGCCACAGATCTGTTC
CTTTGTCCGTTTTTGGGATCCACAGGCCCTATGTATTTGAAGGGAAATGTGTATGGCTCAGATCCTTTTGAAACA
TATCATACAGGTTGCAGTCCTGACCCAAGAACAGTTTTAATGGACCACTATGAGCCCAGTTACATAAAGAAAAAG
GAGTGCTACCCATGTTCTCATCCTTCAGAAGAATCCTGCGAACGGAGCTTCAGTAATATATCGTGGCCTTCACAT
GTGAGGAAGCTACTTAACACTAGTTACTCTCACAATGAAGGACCTGGAATGAAAAATCTGTGTCTAAACAAGTCC
TCTTTAGATTTTAGTGCAAATCCAGAGCCAGCGTCGGTTGCCTCGAGTAATTCTTTCATGGGTACCTTTGGAAAA
GCTCTCAGGAGACCTCACCTAGATGCCTATTCAAGCTTTGGACAGCCATCAGATTGTCAGCCAAGAGCCTTTTAT
TTGAAAGCTCATTCTTCCCCAGACTTGGACTCTGGGTCAGAGGAAGATGGGAAAGAAAGGACAGATTTTCAGGAA
GAAAATCACATTTGTACCTTTAAACAGACTTTAGAAAACTACAGGACTCCAAATTTTCAGTCTTATGACTTGGAC
ACATAGACTGAATGAGACCAAAGGAAAAGCTTAACATACTACCTCAAGTGAACTTTTATTTAAAAGAGAGAAT
CTTATGTTTTTAAATGGAGTTATGAATTTTAAAAGGATAAAAATGCTTTATTTATACAGATGAACCAAAATTAC
AAAAAGTTATGAAAATTTTTATACTGGGAATGATGCTCATATAAGAATACCTTTTTAAACTATTTTTTAACTTTG
TTTTATGCAAAAAAGTATCTTACGTAAATTAATGATATAAATCATGATTATTTTTATGTATTTTTATAATGCCAGA
TTTCTTTTTATGGAAAATGAGTTACTAAAGCATTTTAAATAATACCTGCCTTGTACCATTTTTTAAATAGAAGTT
ACTTCATTATATTTTGCACATTATATTTAATAAAATGTGTCAATTTGAAAAAAAAAAAAAAAAAAAAAAAAAAAAA
```

FIGURE 352

```
MSAPSLRARAAGLGLLLCAVLGRAGRSDSGGRGELGQPSGVAAERPCPTTCRCLGDLLDCSRKRLARLPEPLPSW
VARLDLSHNRLSFIKASSMSHLQSLREVKLNNNELETIPNLGPVSANITLLSLAGNRIVEILPEHLKEFQSLETL
DLSSNNISELQTAFPALQLKYLYLNSNRVTSMEPGYFDNLANTLLVLKLNRNRISAIPPKMFKLPQLQHLELNRN
KIKNVDGLTFQGLGALKSLKMQRNGVTKLMDGAFWGLSNMEILQLDHNNLTEITKGWLYGLLMLQELHLSQNAIN
RISPDAWEFCQKLSELDLTFNHLSRLDDSSFLGLSLLNTLHIGNNRVSYIADCAFRGLSSLKTLDLKNNEISWTI
EDMNGAFSGLDKLRRLILQGNRIRSITKKAFTGLDALEHLDLSDNAIMSLQGNAFSQMKKLQQLHLNTSSLLCDC
QLKWLPQWVAENNFQSFVNASCAHPQLLKGRSIFAVSPDGFVCDDFPKPQITVQPETQSAIKGSNLSFICSAASS
SDSPMTFAWKKDNELLHDAEMENYAHLRAQGGEVMEYTTILRLREVEFASEGKYQCVISNHFGSSYSVKAKLTVN
MLPSFTKTPMDLTIRAGAMARLECAAVGHPAPQIAWQKDGGTDFPAARERRMHVMPEDDVFFIVDVKIEDIGVYS
CTAQNSAGSISANATLTVLETPSFLRPLLDRTVTKGETAVLQCIAGGSPPPKLNWTKDDSPLVVTERHFFAAGNQ
LLIIVDSDVSDAGKYTCEMSNTLGTERGNVRLSVIPTPTCDSPQMTAPSLDDDGWATVGVVIIAVVCCVVGTSLV
WVVIIYHTRRRNEDCSITNTDETNLPADIPSYLSSQGTLADRQDGYVSSESGSHHQFVTSSGAGFFLPQHDSSGT
CHIDNSSEADVEAATDLFLCPFLGSTGPMYLKGNVYGSDPFETYHTGCSPDPRTVLMDHYEPSYIKKKECYPCSH
PSEESCERSFSNISWPSHVRKLLNTSYSHNEGPGMKNLCLNKSSLDFSANPEPASVASSNSFMGTFGKALRRPHL
DAYSSFGQPSDCQPRAFYLKAHSSPDLDSGSEEDGKERTDFQEENHICTFKQTLENYRTPNFQSYDLDT
```

Important features:
Signal sequence:
amino acids 1-27

Transmembrane domain:
amino acids 808-828

N-glycosylation site.
amino acids 122-126, 156-160, 274-278, 442-446, 469-473, 515-519, 688-692, 729-733, 905-909, 987-991, 999-1003, 1016-1020

Glycosaminoglycan attachment site.
amino acids 886-890

Casein kinase II phosphorylation site.
amino acids 99-103, 180-184, 263-267, 314-318, 324-328, 374-378, 383-387, 407-411, 524-528, 608-612, 692-696, 709-713, 731-735, 799-803, 843-847, 863-867, 907-911, 1003-1007, 1018-1022, 1073-1077, 1079-1083, 1081-1085

Tyrosine kinase phosphorylation site.
amino acids 667-675

N-myristoylation site.
amino acids 14-20, 36-42, 239-245, 257-263, 380-386, 427-433, 513-519, 588-594, 672-678, 683-687, 774-780, 933-939

Leucine zipper pattern.
amino acids 58-80, 65-87

FIGURE 353

```
GGGGGTTAGGGAGGAAGGAATCCACCCCCACCCCCCAAACCCTTTTCTTCTCCTTTCCTGGCTTCGGACATTGG
AGCACTAAATGAACTTGAATTGTGTCTGTGGCGAGCAGGATGGTCGCTGTTACTTTGTGATGAGATCGGGGATGA
ATTGCTCGCTTTAAAAATGCTGCTTTGGATTCTGTTGCTGGAGACGTCTCTTTGTTTTGCCGCTGGAAACGTTAC
AGGGGACGTTTGCAAAGAGAAGATCTGTTCCTGCAATGAGATAGAAGGGGACCTACACGTAGACTGTGAAAAAA
GGGCTTCACAAGTCTGCAGCGTTTCACTGCCCCGACTTCCCAGTTTTACCATTTATTTCTGCATGGCAATTCCCT
CACTCGACTTTTCCCTAATGAGTTCGCTAACTTTTATAATGCGGTTAGTTTGCACATGGAAAACAATGGCTTGCA
TGAAATCGTTCCGGGGGCTTTTCTGGGGCTGCAGCTGGTGAAAAGGCTGCACATCAACAACAACAAGATCAAGTC
TTTTCGAAAGCAGACTTTTCTGGGGCTGGACGATCTGGAATATCTCCAGGCTGATTTTAATTTATTACGAGATAT
AGACCCGGGGGCCTTCCAGGACTTGAACAAGCTGGAGGTGCTCATTTTAAATGACAATCTCATCAGCACCCTACC
TGCCAACGTGTTCCAGTATGTGCCCATCACCCACCTCGACCTCCGGGTAACAGGCTGAAAACGCTGCCCTATGA
GGAGGTCTTGGAGCAAATCCCTGGTATTGCGGAGATCCTGCTAGAGGATAACCCTTGGGACTGCACCTGTGATCT
GCTCTCCCTGAAAGAATGGCTGGAAAACATTCCCAAGAATGCCCTGATCGGCCGAGTGGTCTGCGAAGCCCCAC
CAGACTGCAGGGTAAAGACCTCAATGAAACCACCGAACAGGACTTGTGTCCTTTGAAAAACCGAGTGGATTCTAG
TCTCCCGGCGCCCCCTGCCCAAGAAGAGACCTTTGCTCCTGGACCCCTGCCAACTCCTTTCAAGACAAATGGGCA
AGAGGATCATGCCACACCAGGGTCTGCTCCAAACGGAGGTACAAAGATCCCAGGCAACTGGCAGATCAAAATCAG
ACCCACAGCAGCGATAGCGACGGGTAGCTCCAGGAACAAACCCTTAGCTAACAGTTTACCCTGCCCTGGGGGCTG
CAGCTGCGACCACATCCCAGGGTCGGGTTTAAAGATGAACTGCAACAACAGGAACGTGAGCAGCTTGGCTGATTT
GAAGCCCAAGCTCTCTAACGTGCAGGAGCTTTTCCTACGAGATAACAAGATCCACAGCATCCGAAAATCGCACTT
TGTGGATTACAAGAACCTCATTCTGTTGGATCTGGGCAACAATAACATCGCTACTGTAGAGAACAACACTTTCAA
GAACCTTTTGGACCTCAGGTGGCTATACATGGATAGCAATTACCTGGACACGCTGTCCCGGGAGAAATTCGCGGG
GCTGCAAAACCTAGAGTACCTGAACGTGGAGTACAACGCTATCCAGCTCATCCTCCCGGGCACTTTCAATGCCAT
GCCCAAACTGAGGATCCTCATTCTCAACAACAACCTGCTGAGGTCCCTGCCTGTGGACGTGTTCGCTGGGGTCTC
GCTCTCTAAACTCAGCCTGCACAACAATTACTTCATGTACCTCCCGGTGGCAGGGGTGCTGGACCAGTTAACCTC
CATCATCCAGATAGACCTCCACGGAAACCCCTGGGAGTGCTCCTGCACAATTGTGCCTTTCAAGCAGTGGGCAGA
ACGCTTGGGTTCCGAAGTGCTGATGAGCGACCTCAAGTGTGAGACGCCGGTGAACTTCTTTAGAAAGGATTTCAT
GCTCCTCTCCAATGACGAGATCTGCCCTCAGCTGTACGCTAGGATCTCGCCCACGTTAACTTCGCACAGTAAAAA
CAGCACTGGGTTGGCGGAGACCGGGACGCACTCCAACTCCTACCTAGACACCAGCAGGGTGTCCATCTCGGTGTT
GGTCCCGGGACTGCTGCTGGTGTTTGTCACCTCCGCCTTCACCGTGGTGGGCATGCTCGTGTTTATCCTGAGGAA
CCGAAAGCGGTCCAAGAGACGAGATGCCAACTCCTCCGCGTCCGAGATTAATTCCCTACAGACAGTCTGTGACTC
TTCCTACTGGCACAATGGGCCTTACAACGCAGATGGGGCCCACAGAGTGTATGACTGTGGCTCTCACTCGCTCTC
AGACTAAGACCCCAACCCCAATAGGGGAGGGCAGAGGGAAGGCGATACATCCTTCCCCACCGCAGGCACCCCGGG
GGCTGGAGGGGCGTGTACCCAAATCCCCGCGCCATCAGCCTGGATGGGCATAAGTAGATAAATAACTGTGAGCTC
GCACAACCGAAAGGGCCTGACCCCTTACTTAGCTCCCTCCTTGAAACAAAGAGCAGACTGTGGAGAGCTGGGAGA
GCGCAGCCAGCTCGCTCTTTGCTGAGAGCCCCTTTTGACAGAAAGCCCAGCACGACCCTGCTGGAAGAACTGACA
GTGCCCTCGCCCTCGGCCCCGGGGCCTGTGGGGTTGGATGCCGCGGTTCTATACATATATACATATATCCACATC
TATATAGAGAGATAGATATCTATTTTTCCCCTGTGGATTAGCCCCGTGATGGCTCCCTGTTGGCTACGCAGGGAT
GGGCAGTTGCACGAAGGCATGAATGTATTGTAAATAAGTAACTTTGACTTCTGAC
```

FIGURE 354

MLLWILLLETSLCFAAGNVTGDVCKEKICSCNEIEGDLHVDCEKKGFTSLQRFTAPTSQFYHL
FLHGNSLTRLFPNEFANFYNAVSLHMENNGLHEIVPGAFLGLQLVKRLHINNNKIKSFRKQTF
LGLDDLEYLQADFNLLRDIDPGAFQDLNKLEVLILNDNLISTLPANVFQYVPITHLDLRGNRL
KTLPYEEVLEQIPGIAEILLEDNPWDCTCDLLSLKEWLENIPKNALIGRVVCEAPTRLQGKDL
NETTEQDLCPLKNRVDSSLPAPPAQEETFAPGPLPTPFKTNGQEDHATPGSAPNGGTKIPGNW
QIKIRPTAAIATGSSRNKPLANSLPCPGGCSCDHIPGSGLKMNCNNRNVSSLADLKPKLSNVQ
ELFLRDNKIHSIRKSHFVDYKNLILLDLGNNNIATVENNTFKNLLDLRWLYMDSNYLDTLSRE
KFAGLQNLEYLNVEYNAIQLILPGTFNAMPKLRILILNNNLLRSLPVDVFAGVSLSKLSLHNN
YFMYLPVAGVLDQLTSIIQIDLHGNPWECSCTIVPFKQWAERLGSEVLMSDLKCETPVNFFRK
DFMLLSNDEICPQLYARISPTLTSHSKNSTGLAETGTHSNSYLDTSRVSISVLVPGLLLVFVT
SAFTVVGMLVFILRNRKRSKRRDANSSASEINSLQTVCDSSYWHNGPYNADGAHRVYDCGSHS
LSD

Important features:

Signal sequence:
amino acids 1-15

Transmembrane domain:
amino acids 618-638

N-glycosylation site.
amino acids 18-22, 253-257, 363-367, 416-420, 595-599, 655-659 cAMP- and cGMP-dependent protein kinase phosphorylation site.
amino acids 122-126, 646-650

Casein kinase II phosphorylation site.
amino acids 30-34, 180-184, 222-226, 256-260, 366-370, 573-577, 608-612, 657-661, 666-670, 693-697

N-myristoylation site.
amino acids 17-23, 67-73, 100-106, 302-308, 328-334, 343-349, 354-360, 465-471, 493-499, 598-604, 603-609

Prokaryotic membrane lipoprotein lipid attachment site.
amino acids 337-348

FIGURE 355

```
AGTCGACTGCGTCCCCTGTACCCGGCGCCAGCTGTGTTCCTGACCCCAGAATAACTCAGGGCTGCACCGGCCTG
GCAGCGCTCCGCACACATTTCCTGTCGCGGCCTAAGGGAAACTGTTGGCCGCTGGGCCCGCGGGGGGATTCTTGG
CAGTTGGGGGGTCCGTCGGGAGCGAGGGCGGAGGGGAAGGGAGGGGGAACCGGGTTGGGGAAGCCAGCTGTAGAG
GGCGGTGACCGCGCTCCAGACACAGCTCTGCGTCCTCGAGCGGGACAGATCCAAGTTGGGAGCAGCTCTGCGTGC
GGGGCCTCAGAGAATGAGGCCGGCGTTCGCCCTGTGCCTCCTCTGGCAGGCGCTCTGGCCCGGGCCGGGCGGCGG
CGAACACCCCACTGCCGACCGTGCTGGCTGCTCGGCCTCGGGGCCTGCTACAGCCTGCACCACGCTACCATGAA
GCGGCAGGCGGCCGAGGAGGCCTGCATCCTGCGAGGTGGGCGCTCAGCACCGTGCGTGCGGGCGCCGAGCTGCG
CGCTGTGCTCGCGCTCCTGCGGGCAGGCCCAGGGCCCGGAGGGGGCTCCAAAGACCTGCTGTTCTGGGTCGCACT
GGAGCGCAGGCGTTCCCACTGCACCCTGGAGAACGAGCCTTTGCGGGGTTTCTCCTGGCTGTCCTCCGACCCCGG
CGGTCTCGAAAGCGACACGCTGCAGTGGGTGGAGGAGCCCCAACGCTCCTGCACCGCGCGGAGATGCGCGGTACT
CCAGGCCACCGGTGGGGTCGAGCCCGCAGGCTGGAAGGAGATGCGATGCCACCTGCGCGCCAACGGCTACCTGTG
CAAGTACCAGTTTGAGGTCTTGTGTCCTGCGCCGCGCCCCGGGGCCGCCTCTAACTTGAGCTATCGCGCGCCCTT
CCAGCTGCACAGCGCCGCTCTGGACTTCAGTCCACCTGGGACCGAGGTGAGTGCGCTCTGCCGGGGACAGCTCCC
GATCTCAGTTACTTGCATCGCGGACGAAATCGGCGCTCGCTGGGACAAACTCTCGGGCGATGTGTTGTGTCCCTG
CCCCGGGAGGTACCTCCGTGCTGGCAAATGCGCAGAGCTCCCTAACTGCCTAGACGACTTGGGAGGCTTTGCCTG
CGAATGTGCTACGGGCTTCGAGCTGGGGAAGGACGGCCGCTCTTGTGTGACCAGTGGGGAAGGACAGCCGACCCT
TGGGGGGACCGGGGTGCCCACCAGGCGCCCGCCGGCCACTGCAACCAGCCCCGTGCCGCAGAGAACATGGCCAAT
CAGGGTCGACGAGAAGCTGGGAGAGACACCACTTGTCCCTGAACAAGACAATTCAGTAACATCTATTCCTGAGAT
TCCTCGATGGGGATCACAGAGCACGATGTCTACCCTTCAAATGTCCCTTCAAGCCGAGTCAAAGGCCACTATCAC
CCCATCAGGGAGCGTGATTTCCAAGTTTAATTCTACGACTTCCTCTGCCACTCCTCAGGCTTTCGACTCCTCCTC
TGCCGTGGTCTTCATATTTGTGAGCACAGCAGTAGTAGTGTTGGTGATCTTGACCATGACAGTACTGGGCTTGT
CAAGCTCTGCTTTCACGAAAGCCCCTCTTCCCAGCCAAGGAAGGAGTCTATGGGCCCGCCGGGCCTGGAGAGTGA
TCCTGAGCCCGCTGCTTTGGGCTCCAGTTCTGCACATTGCACAAACAATGGGGTGAAAGTCGGGGACTGTGATCT
GCGGGACAGAGCAGAGGGTGCCTTGCTGGCGGAGTCCCCTCTTGGCTCTAGTGATGCATAGGGAAACAGGGGACA
TGGGCACTCCTGTGAACAGTTTTTCACTTTTGATGAAACGGGGAACCAAGAGGAACTTACTTGTGTAACTGACAA
TTTCTGCAGAAATCCCCCTTCCTCTAAATTCCCTTTACTCCACTGAGGAGCTAAATCAGAACTGCACACTCCTTC
CCTGATGATAGAGGAAGTGGAAGTGCCTTTAGGATGGTGATACTGGGGGACCGGGTAGTGCTGGGAGAGATATT
TTCTTATGTTTATTCGGAGAATTTGGAGAAGTGATTGAACTTTTCAAGACATTGGAAACAAATAGAACACAATAT
AATTTACATTAAAAAATAATTTCTACCAAAATGGAAAGGAAATGTTCTATGTTGTTCAGGCTAGGAGTATATTGG
TTCGAAATCCCAGGGAAAAAAATAAAAATAAAAAATTAAAGGATTGTTGAT
```

FIGURE 356

MRPAFALCLLWQALWPGPGGGEHPTADRAGCSASGACYSLHHATMKRQAAEEACILRGGALST
VRAGAELRAVLALLRAGPGPGGGSKDLLFWVALERRRSHCTLENEPLRGFSWLSSDPGGLESD
TLQWVEEPQRSCTARRCAVLQATGGVEPAGWKEMRCHLRANGYLCKYQFEVLCPAPRPGAASN
LSYRAPFQLHSAALDFSPPGTEVSALCRGQLPISVTCIADEIGARWDKLSGDVLCPCPGRYLR
AGKCAELPNCLDDLGGFACECATGFELGKDGRSCVTSGEGQPTLGGTGVPTRRPPATATSPVP
QRTWPIRVDEKLGETPLVPEQDNSVTSIPEIPRWGSQSTMSTLQMSLQAESKATITPSGSVIS
KFNSTTSSATPQAFDSSSAVVFIFVSTAVVVLVILTMTVLGLVKLCFHESPSSQPRKESMGPP
GLESDPEPAALGSSSAHCTNNGVKVGDCDLRDRAEGALLAESPLGSSDA

Important features:

Signal sequence:
amino acids 1-16

Transmembrane domain:
amino acids 399-418

N-glycosylation site.
amino acids 189-193, 381-385

Glycosaminoglycan attachment site.
amino acids 289-293 cAMP- and cGMP-dependent protein kinase phosphorylation site.
amino acids 98-102, 434-438

Casein kinase II phosphorylation site.
amino acids 275-279, 288-292, 342-346, 445-449

N-myristoylation site.
amino acids 30-36, 35-41, 58-64, 59-65, 121-127, 151-157, 185-191, 209-215, 267-273, 350-356, 374-380, 453-459, 463-469, 477-483

Aspartic acid and asparagine hydroxylation site.
amino acids 262-274

FIGURE 357

```
CCCATCTCAAGCTGATCTTGGCACCTCTCATGCTCTGCTCTCTTCAACCAGACCTCTACATTCCATTTTGGAAGA
AGACTAAAAATGGTGTTTCCAATGTGGACACTGAAGAGACAAATTCTTATCCTTTTTAACATAATCCTAATTTCC
AAACTCCTTGGGGCTAGATGGTTTCCTAAAACTCTGCCCTGTGATGTCACTCTGGATGTTCCAAAGAACCATGTG
ATCGTGGACTGCACAGACAAGCATTTGACAGAAATTCCTGGAGGTATTCCCACGAACACCACGAACCTCACCCTC
ACCATTAACCACATACCAGACATCTCCCCAGCGTCCTTTCACAGACTGGACCATCTGGTAGAGATCGATTTCAGA
TGCAACTGTGTACCTATTCCACTGGGGTCAAAAAACAACATGTGCATCAAGAGGCTGCAGATTAAACCCAGAAGC
TTTAGTGGACTCACTTATTTAAAATCCCTTTACCTGGATGGAAACCAGCTACTAGAGATACCGCAGGGCCTCCCG
CCTAGCTTACAGCTTCTCAGCCTTGAGGCCAACAACATCTTTTCCATCAGAAAAGAGAATCTAACAGAACTGGCC
AACATAGAAATACTCTACCTGGGCCAAAACTGTTATTATCGAAATCCTTGTTATGTTTCATATTCAATAGAGAAA
GATGCCTTCCTAAACTTGACAAAGTTAAAAGTGCTCTCCCTGAAAGATAACAATGTCACAGCCGTCCCTACTGTT
TTGCCATCTACTTTAACAGAACTATATCTCTACAACAACATGATTGCAAAAATCCAAGAAGATGATTTTAATAAC
CTCAACCAATTACAAATTCTTGACCTAAGTGGAAATTGCCCTCGTTGTTATAATGCCCCATTTCCTTGTGCGCCG
TGTAAAAATAATTCTCCCCTACAGATCCCTGTAAATGCTTTTGATGCGCTGACAGAATTAAAAGTTTTACGTCTA
CACAGTAACTCTCTTCAGCATGTGCCCCAAGATGGTTTAAGAACATCAACAAACTCCAGGAACTGGATCTGTCC
CAAAACTTCTTGGCCAAAGAAATTGGGGATGCTAAATTTCTGCATTTTCTCCCCAGCCTCATCCAATTGGATCTG
TCTTTCAATTTTGAACTTCAGGTCTATCGTGCATCTATGAATCTATCACAAGCATTTTCTTCACTGAAAGCCTG
AAAATTCTGCGGATCAGAGGATATGTCTTTAAAGAGTTGAAAAGCTTTAACCTCTCGCCATTACATAATCTTCAA
AATCTTGAAGTTCTTGATCTTGGCACTAACTTTATAAAAATTGCTAACCTCAGCATGTTTAAACAATTTAAAAGA
CTGAAAGTCATAGATCTTTCAGTGAATAAAATATCACCTTCAGGAGATTCAAGTGAAGTTGGCTTCTGCTCAAAT
GCCAGAACTTCTGTAGAAAGTTATGAACCCCAGGTCCTGGAACAATTACATTATTTCAGATATGATAAGTATGCA
AGGAGTTGCAGATTCAAAAACAAAGAGGCTTCTTTCATGTCTGTTAATGAAAGCTGCTACAAGTATGGGCAGACC
TTGGATCTAAGTAAAAATAGTATATTTTTGTCAAGTCCTCTGATTTTCAGCATCTTTCTTTCCTCAAATGCCTG
AATCTGTCAGGAAATCTCATTAGCCAAACTCTTAATGGCAGTGAATTCCAACCTTTAGCAGAGCTGAGATATTTG
GACTTCTCCAACAACCGGCTTGATTTACTCCATTCAACAGCATTTGAAGAGCTTCACAAACTGGAAGTTCTGGAT
ATAAGCAGTAATAGCCATTATTTTCAATCAGAAGGAATTACTCATATGCTAAACTTTACCAAGAACCTAAAGGTT
CTGCAGAAACTGATGATGAACGACAATGACATCTCTTCCTCCACCAGCAGGACCATGGAGAGTGAGTCTCTTAGA
ACTCTGGAATTCAGAGGAAATCACTTAGATGTTTTATGGAGAGAAGGTGATAACAGATACTTACAATTATTCAAG
AATCTGCTAAAATTAGAGGAATTAGACATCTCTAAAAATTCCCTAAGTTTCTTGCCTTCTGGAGTTTTTGATGGT
ATGCCTCCAAATCTAAAGAATCTCTCTTTGGCCAAAAATGGGCTCAAATCTTTCAGTTGGAAGAAACTCCAGTGT
CTAAAGAACCTGGAAACTTTGGACCTCAGCCACAACCAACTGACCACTGTCCCTGAGAGATTATCCAACTGTTCC
AGAAGCCTCAAGAATCTGATTCTTAAGAATAATCAAATCAGGAGTCTGACGAAGTATTTCTACAAGATGCCTTC
CAGTTGCGATATCTGGATCTCAGCTCAAATAAAATCCAGATGATCCAAAAGACCAGCTTCCCAGAAAATGTCCTC
AACAATCTGAAGATGTTGCTTTTGCATCATAATCGGTTTCTGTGCACCTGTGATGCTGTGTGGTTTGTCTGGTGG
GGTTAACCATACGGAGGTGACTATTCCTTACCTGGCCACAGATGTGACTTGTGTGGGGCCAGGAGCACACAAGGGC
CAAAGTGTGATCTCCCTGGATCTGTACACCTGTGAGTTAGATCTGACTAACCTGATTCTGTTCTCACTTTCCATA
TCTGTATCTCTCTTTCTCATGGTGATGATGACAGCAAGTCACCTCTATTTCTGGGATGTGTGGTATATTTACCAT
TTCTGTAAGGCCAAGATAAAGGGGTATCAGCGTCTAATATCACCAGACTGTTGCTATGATGCTTTTATTGTGTAT
GACACTAAAGACCCAGCTGTGACCGAGTGGGTTTTGGCTGAGCTGGTGGCCAAACTGGAAGACCCAAGAGAGAAA
CATTTTAATTTATGTCTCGAGGAAAGGGACTGGTTACCAGGGCAGCCAGTTCTGGAAAACCTTTCCCAGAGCATA
CAGCTTAGCAAAAGACAGTGTTTGTGATGACAGACAAGTATGCAAAGACTGAAAATTTTAAGATAGCATTTTAC
TTGTCCCATCAGAGGCTCATGGATGAAAAGTTGATGTGATTATCTTGATATTTCTTGAAGCCCTTTCAGAAG
TCCAAGTTCCTCCAGCTCCGGAAAAGGCTCTGTGGGAGTTCTGTCCTTGAGTGGCCAACAAACCCGCAAGCTCAC
CCATACTTCTGGCAGTGTCTAAAGAACGCCCTGGCCACAGACAATCATGTGGCCTATAGTCAGGTGTTCAAGGAA
ACGGTCTAGCCCTTCTTTGCAAAACACAACTGCCTAGTTTACCAAGGAGAGGCCTGGC
```

FIGURE 358

MVFPMWTLKRQILILFNIILISKLLGARWFPKTLPCDVTLDVPKNHVIVDCTDKHLTEIPGGI
PTNTTNLTLTINHIPDISPASFHRLDHLVEIDFRCNCVPIPLGSKNNMCIKRLQIKPRSFSGL
TYLKSLYLDGNQLLEIPQGLPPSLQLLSLEANNIFSIRKENLTELANIEILYLGQNCYYRNPC
YVSYSIEKDAFLNLTKLKVLSLKDNNVTAVPTVLPSTLTELYLYNNMIAKIQEDDFNNLNQLQ
ILDLSGNCPRCYNAPFPCAPCKNNSPLQIPVNAFDALTELKVLRLHSNSLQHVPPRWFKNINK
LQELDLSQNFLAKEIGDAKFLHFLPSLIQLDLSFNFELQVYRASMNLSQAFSSLKSLKILRIR
GYVFKELKSFNLSPLHNLQNLEVLDLGTNFIKIANLSMFKQFKRLKVIDLSVNKISPSGDSSE
VGFCSNARTSVESYEPQVLEQLHYFRYDKYARSCRFKNKEASFMSVNESCYKYGQTLDLSKNS
IFFVKSSDFQHLSFLKCLNLSGNLISQTLNGSEFQPLAELRYLDFSNNRLDLLHSTAFEELHK
LEVLDISSNSHYFQSEGITHMLNFTKNLKVLQKLMMNDNDISSSTSRTMESESLRTLEFRGNH
LDVLWREGDNRYLQLFKNLLKLEELDISKNSLSFLPSGVFDGMPPNLKNLSLAKNGLKSFSWK
KLQCLKNLETLDLSHNQLTTVPERLSNCSRSLKNLILKNNQIRSLTKYFLQDAFQLRYLDLSS
NKIQMIQKTSFPENVLNNLKMLLLHHNRFLCTCDAVWFVWWVNHTEVTIPYLATDVTCVGPGA
HKGQSVISLDLYTCELDLTNLILFSLSISVSLFLMVMMTASHLYFWDVWYIYHFCKAKIKGYQ
RLISPDCCYDAFIVYDTKDPAVTEWVLAELVAKLEDPREKHFNLCLEERDWLPGQPVLENLSQ
SIQLSKKTVFVMTDKYAKTENFKIAFYLSHQRLMDEKVDVIILIFLEKPFQKSKFLQLRKRLC
GSSVLEWPTNPQAHPYFWQCLKNALATDNHVAYSQVFKETV

Important features:
Signal sequence:
amino acids 1-26

Transmembrane domain:
amino acids 840-860

FIGURE 359

GACGGCTGGCCACCATGCACGGCTCCTGCAGTTTCCTGATGCTTCTGCTGCCGCTACTGCTAC
TGCTGGTGGCCACCACAGGCCCCGTTGGAGCCCTCACAGATGAGGAGAAACGTTTGATGGTGG
AGCTGCACAACCTCTACCGGGCCCAGGTATCCCCGACGGCCTCAGACATGCTGCACATGAGAT
GGGACGAGGAGCTGGCCGCCTTCGCCAAGGCCTACGCACGGCAGTGCGTGTGGGCCACAACA
AGGAGCGCGGGCGCCGCGGCGAGAATCTGTTCGCCATCACAGACGAGGGCATGGACGTGCCGC
TGGCCATGGAGGAGTGGCACCACGAGCGTGAGCACTACAACCTCAGCGCCGCCACCTGCAGCC
CAGGCCAGATGTGCGGCCACTACACGCAGGTGGTATGGGCCAAGACAGAGAGGATCGGCTGTG
GTTCCCACTTCTGTGAGAAGCTCCAGGGTGTTGAGGAGACCAACATCGAATTACTGGTGTGCA
ACTATGAGCCTCCGGGGAACGTGAAGGGGAAACGGCCCTACCAGGAGGGGACTCCGTGCTCCC
AATGTCCCTCTGGCTACCACTGCAAGAACTCCCTCTGTGAACCCATCGGAAGCCCGGAAGATG
CTCAGGATTTGCCTTACCTGGTAACTGAGGCCCCATCCTTCCGGGCGACTGAAGCATCAGACT
CTAGGAAATGGGTACTCCTTCTTCCCTAGCAACGGGGATTCCGGCTTTCTTGGTAACAGAGG
TCTCAGGCTCCCTGGCAACCAAGGCTCTGCCTGCTGTGGAAACCCAGGCCCCAACTTCCTTAG
CAACGAAAGACCCGCCCTCCATGGCAACAGAGGCTCCACCTTGCGTAACAACTGAGGTCCCTT
CCATTTTGGCAGCTCACAGCCTGCCCTCCTTGGATGAGGAGCCAGTTACCTTCCCCAAATCGA
CCCATGTTCCTATCCCAAAATCAGCAGACAAAGTGACAGACAAAACAAAAGTGCCCTCTAGGA
GCCCAGAGAACTCTCTGGACCCCAAGATGTCCCTGACAGGGGCAAGGGAACTCCTACCCCATG
CCCAGGAGGAGGCTGAGGCTGAGGCTGAGTTGCCTCCTTCCAGTGAGGTCTTGGCCTCAGTTT
TTCCAGCCCAGGACAAGCCAGGTGAGCTGCAGGCCACACTGGACCACACGGGGCACACCTCCT
CCAAGTCCCTGCCCAATTTCCCCAATACCTCTGCCACCGCTAATGCCACGGGTGGGCGTGCCC
TGGCTCTGCAGTCGTCCTTGCCAGGTGCAGAGGGCCCTGACAAGCCTAGCGTTGTGTCAGGGC
TGAACTCGGGCCCTGGTCATGTGTGGGGCCCTCTCCTGGGACTACTGCTCCTGCCTCCTCTGG
TGTTGGCTGGAATCTTCTGAATGGGATACCACTCAAAGGGTGAAGAGGTCAGCTGTCCTCCTG
TCATCTTCCCCACCCTGTCCCCAGCCCCTAAACAAGATACTTCTTGGTTAAGGCCCTCCGGAA
GGGAAAGGCTACGGGGCATGTGCCTCATCACACCATCCATCCTGGAGGCACAAGGCCTGGCTG
GCTGCGAGCTCAGGAGGCCGCCTGAGGACTGCACACCGGGCCCACACCTCTCCTGCCCCTCCC
TCCTGAGTCCTGGGGGTGGAGGATTTGAGGGAGCTCACTGCCTACCTGGCCTGGGGCTGTCT
GCCCACACAGCATGTGCGCTCTCCCTGAGTGCCTGTGTAGCTGGGGATGGGGATTCCTAGGGG
CAGATGAAGGACAAGCCCCACTGGAGTGGGGTTCTTTGAGTGGGGGAGGCAGGGACGAGGGAA
GGAAAGTAACTCCTGACTCTCCAATAAAAACCTGTCCAACCTGTGAAA

FIGURE 360

```
MHGSCSFLMLLLPLLLLLVATTGPVGALTDEEKRLMVELHNLYRAQVSPTASDMLHMRWDEEL
AAFAKAYARQCVWGHNKERGRRGENLFAITDEGMDVPLAMEEWHHEREHYNLSAATCSPGQMC
GHYTQVVWAKTERIGCGSHFCEKLQGVEETNIELLVCNYEPPGNVKGKRPYQEGTPCSQCPSG
YHCKNSLCEPIGSPEDAQDLPYLVTEAPSFRATEASDSRKMGTPSSLATGIPAFLVTEVSGSL
ATKALPAVETQAPTSLATKDPPSMATEAPPCVTTEVPSILAAHSLPSLDEEPVTFPKSTHVPI
PKSADKVTDKTKVPSRSPENSLDPKMSLTGARELLPHAQEEAEAEAELPPSSEVLASVFPAQD
KPGELQATLDHTGHTSSKSLPNFPNTSATANATGGRALALQSSLPGAEGPDKPSVVSGLNSGP
GHVWGPLLGLLLLPPLVLAGIF
```

Important features:
Signal sequence:
amino acids 1-22

N-glycosylation site.
amino acids 114-118, 403-407, 409-413

Glycosaminoglycan attachment site.
amino acids 439-443

Casein kinase II phosphorylation site.
amino acids 29-33, 50-54, 156-160, 195-199, 202-206, 299-303

N-myristoylation site.
amino acids 123-129, 143-149, 152-158, 169-175, 180-186, 231-237, 250-256

Amidation site.
amino acids 82-86, 172-176

Peroxidases proximal heme-ligand signature.
amino acids 287-298

Extracellular proteins SCP/Tpx-1/Ag5/PR-1/Sc7 signature 1.
amino acids 127-138

Extracellular proteins SCP/Tpx-1/Ag5/PR-1/Sc7 signature 2.
amino acids 160-172

FIGURE 361

```
GACTAGTTCTCTTGGAGTCTGGGAGGAGGAAAGCGGAGCCGGCAGGGAGCGAACCAGGACTGG
GGTGACGGCAGGGCAGGGGGCGCCTGGCCGGGGAGAAGCGCGGGGGCTGGAGCACCACCAACT
GGAGGGTCCGGAGTAGCGAGCGCCCCGAAGGAGGCCATCGGGGAGCCGGGAGGGGGACTGCG
AGAGGACCCCGGCGTCCGGGCTCCCGGTGCCAGCGCTATGAGGCCACTCCTCGTCCTGCTGCT
CCTGGGCCTGGCGGCCGGCTCGCCCCACTGGACGACAACAAGATCCCCAGCCTCTGCCCGGG
GCACCCCGGCCTTCCAGGCACGCCGGCCACCATGGCAGCCAGGGCTTGCCGGGCCGCGATGG
CCGCGACGGCCGCGACGGCGCGCCCGGGCTCCGGGAGAGAAGGCGAGGGCGGGAGGCCGGG
ACTGCCGGGACCTCGAGGGGACCCCGGGCCGCGAGGAGAGGCGGGACCCGCGGGGCCCACCGG
GCCTGCCGGGAGTGCTCGGTGCCTCCGCGATCCGCCTTCAGCGCCAAGCGCTCCGAGAGCCG
GGTGCCTCCGCCGTCTGACGCACCCTTGCCCTTCGACCGCGTGCTGGTGAACGAGCAGGGACA
TTACGACGCCGTCACCGGCAAGTTCACCTGCCAGGTGCCTGGGGTCTACTACTTCGCCGTCCA
TGCCACCGTCTACCGGGCCAGCCTGCAGTTTGATCTGGTGAAGAATGGCGAATCCATTGCCTC
TTTCTTCCAGTTTTTCGGGGGGTGGCCCAAGCCAGCCTCGCTCTCGGGGGGGCCATGGTGAG
GCTGGAGCCTGAGGACCAAGTGTGGGTGCAGGTGGGTGTGGGTGACTACATTGGCATCTATGC
CAGCATCAAGACAGACAGCACCTTCTCCGGATTTCTGGTGTACTCCGACTGGCACAGCTCCCC
AGTCTTTGCTTAGTGCCCACTGCAAAGTGAGCTCATGCTCTCACTCCTAGAAGGAGGGTGTGA
GGCTGACAACCAGGTCATCCAGGAGGGCTGGCCCCCTGGAATATTGTGAATGACTAGGGAGG
TGGGGTAGAGCACTCTCCGTCCTGCTGCTGGCAAGGAATGGGAACAGTGGCTGTCTGCGATCA
GGTCTGGCAGCATGGGGCAGTGGCTGGATTTCTGCCCAAGACCAGAGGAGTGTGCTGTGCTGG
CAAGTGTAAGTCCCCCAGTTGCTCTGGTCCAGGAGCCCACGGTGGGGTGCTCTCTTCCTGGTC
CTCTGCTTCTCTGGATCCTCCCCACCCCCTCCTGCTCCTGGGGCCGGCCCTTTTCTCAGAGAT
CACTCAATAAACCTAAGAACCCTCATAAAAAAAAAAAAAAAAAAAAAAAAAAA
```

FIGURE 362

MRPLLVLLLLGLAAGSPPLDDNKIPSLCPGHPGLPGTPGHHGSQGLPGRDGRDGRDGAPGAPG
EKGEGGRPGLPGPRGDPGPRGEAGPAGPTGPAGECSVPPRSAFSAKRSESRVPPPSDAPLPFD
RVLVNEQGHYDAVTGKFTCQVPGVYYFAVHATVYRASLQFDLVKNGESIASFFQFFGGWPKPA
SLSGGAMVRLEPEDQVWVQVGVGDYIGIYASIKTDSTFSGFLVYSDWHSSPVFA

Important features:

Signal sequence.

amino acids 1-15

N-myristoylation sites.

amino acids 11-17, 68-74, 216-222

Cell attachment sequence.

amino acids 77-80

FIGURE 363

GGAGAGCGGAGCGAAGCTGGATAACAGGGGACCG<u>ATG</u>ATGTGGCGACCATCAGTTCTGCTGCT
TCTGTTGCTACTGAGGCACGGGGCCCAGGGGAAGCCATCCCCAGACGCAGGCCCTCATGGCCA
GGGGAGGGTGCACCAGGCGGCCCCCCTGAGCGACGCTCCCCATGATGACGCCCACGGGAACTT
CCAGTACGACCATGAGGCTTTCCTGGGACGGGAAGTGGCCAAGGAATTCGACCAACTCACCCC
AGAGGAAAGCCAGGCCCGTCTGGGCGGATCGTGGACCGCATGGACCGCGCGGGGACGGCGA
CGGCTGGGTGTCGCTGGCCGAGCTTCGCGCGTGGATCGCGCACACGCAGCAGCGGCACATACG
GGACTCGGTGAGCGCGGCCTGGGACACGTACGACACGGACCGCGACGGGCGTGTGGGTTGGGA
GGAGCTGCGCAACGCCACCTATGGCCACTACGCGCCCGGTGAAGAATTTCATGACGTGGAGGA
TGCAGAGACCTACAAAAGATGCTGGCTCGGGACGAGCGGCGTTTCCGGGTGGCCGACCAGGA
TGGGGACTCGATGGCCACTCGAGAGGAGCTGACAGCCTTCCTGCACCCCGAGGAGTTCCCTCA
CATGCGGGACATCGTGATTGCTGAAACCCTGGAGGACCTGGACAGAAACAAAGATGGCTATGT
CCAGGTGGAGGAGTACATCGCGGATCTGTACTCAGCCGAGCCTGGGGAGGAGGAGCCGGCGTG
GGTGCAGACGGAGAGGCAGCAGTTCCGGGACTTCCGGGATCTGAACAAGGATGGGCACCTGGA
TGGGAGTGAGGTGGGCCACTGGGTGCTGCCCCCTGCCCAGGACCAGCCCCTGGTGGAAGCCAA
CCACCTGCTGCACGAGAGCGACACGGACAAGGATGGGCGGCTGAGCAAAGCGGAAATCCTGGG
TAATTGGAACATGTTTGTGGGCAGTCAGGCCACCAACTATGGCGAGGACCTGACCCGGCACCA
CGATGAGCTG<u>TGA</u>GCACCGCGCACCTGCCACAGCCTCAGAGGCCCGCACAATGACCGGAGGAG
GGGCCGCTGTGGTCTGGCCCCCTCCCTGTCCAGGCCCCGCAGGAGGCAGATGCAGTCCCAGGC
ATCCTCCTGCCCCTGGGCTCTCAGGGACCCCCTGGGTCGGCTTCTGTCCCTGTCACACCCCCA
ACCCCAGGGAGGGGCTGTCATAGTCCCAGAGGATAAGCAATACCTATTTCTGACTGAGTCTCC
CAGCCCAGACCCAGGGACCCTTGGCCCCAAGCTCAGCTCTAAGAACCGCCCCAACCCCTCCAG
CTCCAAATCTGAGCCTCCACCACATAGACTGAAACTCCCCTGGCCCCAGCCCTCTCCTGCCTG
GCCTGGCCTGGGACACCTCCTCTCTGCCAGGAGGCAATAAAAGCCAGCGCCGGGACCTTGAAA
AAAAAAAAAAAAAAAAAAAAAAAAAAAAAAAAAAAAAAAAAAAAAAAAAAAA

FIGURE 364

MMWRPSVLLLLLLLLRHGAQGKPSPDAGPHGQGRVHQAAPLSDAPHDDAHGNFQYDHEAFLGRE
VAKEFDQLTPEESQARLGRIVDRMDRAGDGDGWVSLAELRAWIAHTQQRHIRDSVSAAWDTYD
TDRDGRVGWEELRNATYGHYAPGEEFHDVEDAETYKKMLARDERRFRVADQDGDSMATREELT
AFLHPEEFPHMRDIVIAETLEDLDRNKDGYVQVEEYIADLYSAEPGEEEPAWVQTERQQFRDF
RDLNKDGHLDGSEVGHWVLPPAQDQPLVEANHLLHESDTDKDGRLSKAEILGNWNMFVGSQAT
NYGEDLTRHHDEL

Important features:

Signal sequence:

amino acids 1-20

N-glycosylation site.

amino acids 140-144

Casein kinase II phosphorylation site.

amino acids 72-76, 98-102, 127-131, 184-188, 208-212, 289-293, 291-295, 298-302

N-myristoylation site.

amino acids 263-269, 311-317

Endoplasmic reticulum targeting sequence.

amino acids 325-330

FIGURE 365

```
GTCTGTTCCCAGGAGTCCTTCGGCGGCTGTTGTGTCAGTGGCCTGATCGCGATGGGGACAAAG
GCGCAAGTCGAGAGGAAACTGTTGTGCCTCTTCATATTGGCGATCCTGTTGTGCTCCCTGGCA
TTGGGCAGTGTTACAGTGCACTCTTCTGAACCTGAAGTCAGAATTCCTGAGAATAATCCTGTG
AAGTTGTCCTGTGCCTACTCGGGCTTTTCTTCTCCCGTGTGGAGTGGAAGTTTGACCAAGGA
GACACCACCAGACTCGTTTGCTATAATAACAAGATCACAGCTTCCTATGAGGACCGGGTGACC
TTCTTGCCAACTGGTATCACCTTCAAGTCCGTGACACGGGAAGACACTGGGACATACACTTGT
ATGGTCTCTGAGGAAGGCGGCAACAGCTATGGGGAGGTCAAGGTCAAGCTCATCGTGCTTGTG
CCTCCATCCAAGCCTACAGTTAACATCCCCTCCTCTGCCACCATTGGGAACCGGGCAGTGCTG
ACATGCTCAGAACAAGATGGTTCCCCACCTTCTGAATACACCTGGTTCAAAGATGGGATAGTG
ATGCCTACGAATCCCAAAAGCACCCGTGCCTTCAGCAACTCTTCCTATGTCCTGAATCCCACA
ACAGGAGAGCTGGTCTTTGATCCCCTGTCAGCCTCTGATACTGGAGAATACAGCTGTGAGGCA
CGGAATGGGTATGGGACACCCATGACTTCAAATGCTGTGCGCATGGAAGCTGTGGAGCGGAAT
GTGGGGGTCATCGTGGCAGCCGTCCTTGTAACCCTGATTCTCCTGGGAATCTTGGTTTTTGGC
ATCTGGTTTGCCTATAGCCGAGGCCACTTTGACAGAACAAAGAAAGGGACTTCGAGTAAGAAG
GTGATTTACAGCCAGCCTAGTGCCCGAAGTGAAGGAGAATTCAAACAGACCTCGTCATTCCTG
GTGTGAGCCTGGTCGGCTCACCGCCTATCATCTGCATTTGCCTTACTCAGGTGCTACCGGACT
CTGGCCCCTGATGTCTGTAGTTTCACAGGATGCCTTATTTGTCTTCTACACCCCACAGGGCCC
CCTACTTCTTCGGATGTGTTTTAATAATGTCAGCTATGTGCCCCATCCTCCTTCATGCCCTC
CCTCCCTTTCCTACCACTGCTGAGTGGCCTGGAACTTGTTTAAAGTGTTTATTCCCCATTTCT
TTGAGGGATCAGGAAGGAATCCTGGGTATGCCATTGACTTCCCTTCTAAGTAGACAGCAAAAA
TGGCGGGGGTCGCAGGAATCTGCACTCAACTGCCCACCTGGCTGGCAGGGATCTTTGAATAGG
TATCTTGAGCTTGGTTCTGGGCTCTTTCCTTGTGTACTGACGACCAGGGCCAGCTGTTCTAGA
GCGGGAATTAGAGGCTAGAGCGGCTGAAATGGTTGTTTGGTGATGACACTGGGGTCCTTCCAT
CTCTGGGGCCCACTCTCTTCTGTCTTCCCATGGGAAGTGCCACTGGGATCCCTCTGCCCTGTC
CTCCTGAATACAAGCTGACTGACATTGACTGTGTCTGTGGAAAATGGGAGCTCTTGTTGTGGA
GAGCATAGTAAATTTTCAGAGAACTTGAAGCCAAAAGGATTTAAAACCGCTGCTCTAAAGAAA
AGAAAACTGGAGGCTGGGCGCAGTGGCTCACGCCTGTAATCCCAGAGGCTGAGGCAGGCGGAT
CACCTGAGGTCGGGAGTTCGGGATCAGCCTGACCAACATGGAGAAACCCTACTGGAAATACAA
AGTTAGCCAGGCATGGTGGTGCATGCCTGTAGTCCCAGCTGCTCAGGAGCCTGGCAACAAGAG
CAAAACTCCAGCTCAAAAAAAAAAAAAAAA
```

FIGURE 366

MGTKAQVERKLLCLFILAILLCSLALGSVTVHSSEPEVRIPENNPVKLSCAYSGFSSPRVEWK
FDQGDTTRLVCYNNKITASYEDRVTFLPTGITFKSVTREDTGTYTCMVSEEGGNSYGEVKVKL
IVLVPPSKPTVNIPSSATIGNRAVLTCSEQDGSPPSEYTWFKDGIVMPTNPKSTRAFSNSSYV
LNPTTGELVFDPLSASDTGEYSCEARNGYGTPMTSNAVRMEAVERNVGVIVAAVLVTLILLGI
LVFGIWFAYSRGHFDRTKKGTSSKKVIYSQPSARSEGEFKQTSSFLV

Important features:
Signal sequence:
amino acids 1-27

Transmembrane domain:
amino acids 238-255

N-glycosylation site.
amino acids 185-189 cAMP- and cGMP-dependent protein kinase phosphorylation site.
amino acids 270-274

Casein kinase II phosphorylation site.
amino acids 34-38, 82-86, 100-104, 118-122, 152-156, 154-158, 193-197, 203-207, 287-291

N-myristoylation site.
amino acids 105-111, 116-122, 158-164, 219-225, 237-243, 256-262

FIGURE 367

```
GGGGAGAGGAATTGACCATGTAAAAGGAGACTTTTTTTTTTGGTGGTGGTGGCTGTTGGGTGCCTTGCAAAAATG
AAGGATGCAGGACGCAGCTTTCTCCTGGAACCGAACGCAATGGATAAACTGATTGTGCAAGAGAGAAGGAAGAAC
GAAGCTTTTTCTTGTGAGCCCTGGATCTTAACACAAATGTGTATATGTGCACACAGGGAGCATTCAAGAATGAAA
TAAACCAGAGTTAGACCCGCGGGGGTTGGTGTGTTCTGACATAAATAAATAATCTTAAAGCAGCTGTTCCCCTCC
CCACCCCCAAAAAAAAGGATGATTGGAAATGAAGAACCGAGGATTCACAAAGAAAAAAGTATGTTCATTTTTCTC
TATAAAGGAGAAAGTGAGCCAAGGAGATATTTTTGGAATGAAAAGTTTGGGGCTTTTTTAGTAAAGTAAAGAACT
GGTGTGGTGGTGTTTTCCTTTCTTTTTGAATTTCCCACAAGAGGAGAGGAAATTAATAATACATCTGCAAAGAAA
TTTCAGAGAAGAAAGTTGACCGCGGCAGATTGAGGCATTGATTGGGGGAGAGAAACCAGCAGAGCACAGTTGGA
TTTGTGCCTATGTTGACTAAAATTGACGGATAATTGCAGTTGGATTTTTCTTCATCAACCTCCTTTTTTTTAAAT
TTTTATTCCTTTTGGTATCAAGATCATGCGTTTTCTCTTGTTCTTAACCACCTGGATTTCCATCTGGATGTTGCT
GTGATCAGTCTGAAATACAACTGTTTGAATTCCAGAAGGACCAACACCAGATAAATTATGAATGTTAACAAGAT
GACCTTACATCCACAGCAGATAATGATAGGTCCTAGGTTTAACAGGGCCCTATTTGACCCCCTGCTTGTGGTGCT
GCTGGCTCTTCAACTTCTTGTGGTGGCTGGTCTGGTGCGGGCTCAGACCTGCCCTTCTGTGTGCTCCTGCAGCAA
CCAGTTCAGCAAGGTGATTTGTGTTCGGAAAAACCTGCGTGAGGTTCCGGATGGCATCTCCACCAACACACGGCT
GCTGAACCTCCATGAGAACCAAATCCAGATCATCAAAGTGAACAGCTTCAAGCACTTGAGGCACTTGGAAATCCT
ACAGTTGAGTAGGAACCATATCAGAACCATTGAAATTGGGGCTTTCAATGGTCTGGCGAACCTCAACACTCTGGA
ACTCTTTGACAATCGTCTTACTACCATCCCGAATGGAGCTTTTGTATACTTGTCTAAACTGAAGGAGCTCTGGTT
GCGAAACAACCCCATTGAAAGCATCCCTTCTTATGCTTTTAACAGAATTCCTTCTTTGCGCCGACTAGACTTAGG
GGAATTGAAAAGACTTTCATACATCTCAGAAGGTGCCTTTGAAGGTCTGTCCAACTTGAGGTATTTGAACCTTGC
CATGTGCAACCTTCGGGAAATCCCTAACCTCACACCGCTCATAAAACTAGATGAGCTGGATCTTTCTGGGAATCA
TTTATCTGCCATCAGGCCTGGCTCTTTCCAGGGTTTGATGCACCTTCAAAAACTGTGGATGATACAGTCCCAGAT
TCAAGTGATTGAACGGAATGCCTTTGACAACCTTCAGTCACTAGTGGAGATCAACCTGGCACACAATAATCTAAC
ATTACTGCCTCATGACCTCTTCACTCCCTTGCATCATCTAGAGCGGATACATTTACATCACAACCCTTGGAACTG
TAACTGTGACATACTGTGGCTCAGCTGGTGGATAAAAGACATGCCCCCTCGAACACAGCTTGTTGTGCCCGGTG
TAACACTCCTCCCAATCTAAAGGGGAGGTACATTGGAGGCTCGACCAGAATTACTTCACATGCTATGCTCCGGT
GATTGTGGAGCCCCCTGCAGACCTCAATGTCACTGAAGGCATGCAGCTGAGCTGAAATGTCGGGCCTCCACATC
CCTGACATCTGTATCTTGGATTACTCCAAATGGAACAGTCATGACACATGGGGCGTACAAAGTGCGGATAGCTGT
GCTCAGTGATGGTACGTTAAATTTCACAAATGTAACTGTGCAAGATACAGGCATGTACACATGTATGGTGAGTAA
TTCCGTTGGGAATACTACTGCTTCAGCCACCCTGAATGTTACTGCAGCAACCACTACTCCTTTCTCTTACTTTTC
AACCGTCACAGTAGAGACTATGGAACCGTCTCAGGATGAGGCACGGACCACAGATAACAATGTGGGTCCCACTCC
AGTGGTCGACTGGGAGACCACCAATGTGACCACCTCTCTCACACCACAGAGCACAAGGTCGACAGAGAAACCTT
CACCATCCCAGTGACTGATATAAACAGTGGGATCCCAGGAATTGATGAGGTCATGAAGACTACCAAAATCATCAT
TGGGTGTTTTGTGGCCATCACACTCATGGCTGCAGTGATGCTGGTCATTTTCTACAAGATGAGGAAGCAGCACCA
TCGGCAAAACCATCACGCCCCAACAAGGACTGTTGAAATTATTAATGTGGATGATGAGATTACGGGAGACACACC
CATGGAAAGCCACCTGCCCATGCCTGCTATCGAGCATGAGCACCTAAATCACTATAACTCATACAAATCTCCCTT
CAACCACACAACAACAGTTAACACAATAAATTCAATACACAGTTCAGTGCATGAACCGTTATTGATCCGAATGAA
CTCTAAAGACAATGTACAAGAGACTCAAATCTAAAACATTTACAGAGTTACAAAAAACAAACAATCAAAAAAAAA
GACAGTTTATTAAAAATGACACAAATGACTGGGCTAAATCTACTGTTTCAAAAAAGTGTCTTTACAAAAAAACAA
AAAAGAAAAGAAATTTATTTATTAAAAATTCTATTGTGATCTAAAGCAGACAAAAA
```

FIGURE 368

MLNKMTLHPQQIMIGPRFNRALFDPLLVVLLALQLLVVAGLVRAQTCPSVCSCSNQFSKVICVRKNLREVPDGIS
TNTRLLNLHENQIQIIKVNSFKHLRHLEILQLSRNHIRTIEIGAFNGLANLNTLELFDNRLTTIPNGAFVYLSKL
KELWLRNNPIESIPSYAFNRIPSLRRLDLGELKRLSYISEGAFEGLSNLRYLNLAMCNLREIPNLTPLIKLDELD
LSGNHLSAIRPGSFQGLMHLQKLWMIQSQIQVIERNAFDNLQSLVEINLAHNNLTLLPHDLFTPLHHLERIHLHH
NPWNCNCDILWLSWWIKDMAPSNTACCARCNTPPNLKGRYIGELDQNYFTCYAPVIVEPPADLNVTEGMAAELKC
RASTSLTSVSWITPNGTVMTHGAYKVRIAVLSDGTLNFTNVTVQDTGMYTCMVSNSVGNTTASATLNVTAATTTP
FSYFSTVTVETMEPSQDEARTTDNNVGPTPVVDWETTNVTTSLTPQSTRSTEKTFTIPVTDINSGIPGIDEVMKT
TKIIGCFVAITLMAAVMLVIFYKMRKQHHRQNHHAPTRTVEIINVDDEITGDTPMESHLPMPAIEHEHLNHYNS
YKSPFNHTTTVNTINSIHSSVHEPLLIRMNSKDNVQETQI

Important features:
Signal sequence:
amino acids 1-44

Transmembrane domain:
amino acids 523-543

N-glycosylation site.
amino acids 278-282, 364-368, 390-394, 412-416, 415-419, 434-438, 442-446, 488-492, 606-610 cAMP- and cGMP-dependent protein kinase phosphorylation site.
amino acids 183-187

Casein kinase II phosphorylation site.
amino acids 268-272, 417-421, 465-469, 579-583, 620-624

N-myristoylation site.
amino acids 40-46, 73-79, 118-124, 191-197, 228-234, 237-243, 391-397, 422-428, 433-439, 531-537

FIGURE 369

```
CAAAACTTGCGTCGCGGAGAGCGCCCAGCTTGACTTGAATGGAAGGAGCCCGAGCCCGCGGAGCGCAGCTGAGAC
TGGGGGAGCGCGTTCGGCCTGTGGGGCGCCGCTCGGCGCCGGGGCGCAGCAGGGAAGGGGAAGCTGTGGTCTGCC
CTGCTCCACGAGGCGCCACTGGTGTGAACCGGGAGAGCCCCTGGGTGGTCCCGTCCCCTATCCCTCCTTTATATA
GAAACCTTCCACACTGGGAAGGCAGCGGCGAGGCAGGAGGGCTCATGGTGAGCAAGGAGGCCGGCTGATCTGCAG
GCGCACAGCATTCCGAGTTTACAGATTTTTACAGATACCAAATGGAAGGCGAGGAGGCAGAACAGCCTGCCTGGT
TCCATCAGCCCTGGCGCCCAGGCGCATCTGACTCGGCACCCCTGCAGGCACCATGGCCCAGAGCCGGGTGCTGC
TGCTCCTGCTGCTGCTGCCGCCACAGCTGCACCTGGGACCTGTGCTTGCCGTGAGGGCCCCAGGATTTGGCCGAA
GTGGCGGCCACAGCCTGAGCCCCGAAGAGAACGAATTTGCGGAGGAGGAGCCGGTGCTGGTACTGAGCCCTGAGG
AGCCCGGGCCTGGCCCAGCCGCGGTCAGCTGCCCCGAGACTGTGCCTGTTCCCAGGAGGGCGTCGTGGACTGTG
GCGGTATTGACCTGCGTGAGTTCCCGGGGACCTGCCTGAGCACACCAACCACCTATCTCTGCAGAACAACCAGC
TGGAAAAGATCTACCCTGAGGAGCTCTCCCGGCTGCACCGGCTGGAGACACTGAACCTGCAAAACAACCGCCTGA
CTTCCCGAGGGCTCCCAGAGAAGGCGTTTGAGCATCTGACCAACCTCAATTACCTGTACTTGGCCAATAACAAGC
TGACCTTGGCACCCCGCTTCCTGCCAAACGCCCTGATCAGTGTGGACTTTGCTGCCAACTATCTCACCAAGATCT
ATGGGCTCACCTTTGGCCAGAAGCCAAACTTGAGGTCTGTGTACCTGCACAACAACAAGCTGGCAGACGCCGGGC
TGCCGGACAACATGTTCAACGGCTCCAGCAACGTCGAGGTCCTCATCCTGTCCAGCAACTTCCTGCGCCACGTGC
CCAAGCACCTGCCGCCTGCCCTGTACAAGCTGCACCTCAAGAACAACAAGCTGGAGAAGATCCCCCCGGGGGCCT
TCAGCGAGCTGAGCAGCCTGCGCGAGCTATACCTGCAGAACAACTACCTGACTGACGAGGGCCTGGACAACGAGA
CCTTCTGGAAGCTCTCCAGCCTGGAGTACCTGGATCTGTCCAGCAACAACCTGTCTCGGGTCCCAGCTGGGCTGC
CGCGCAGCCTGGTGCTGCTGCACTTGGAGAAGAACGCCATCCGGAGCGTGGACGCGAATGTGCTGACCCCCATCC
GCAGCCTGGAGTACCTGCTGCTGCACAGCAACCAGCTGCGGGAGCAGGGCATCCACCCACTGGCCTTCCAGGGCC
TCAAGCGGTTGCACACGGTGCACCTGTACAACAACGCGCTGGAGCGCGTGCCCAGTGGCCTGCCTCGCCGCGTGC
GCACCCTCATGATCCTGCACAACCAGATCACAGGCATTGGCCGCGAAGACTTTGCCACCACCTACTTCCTGGAGG
AGCTCAACCTCAGCTACAACCGCATCACCAGCCCACAGGTGCACCGCGACGCCTTCCGCAAGCTGCGCCTGCTGC
GCTCGCTGGACCTGTCGGGCAACCGGCTGCACACGCTGCCACCTGGGCTGCCTCGAAATGTCCATGTGCTGAAGG
TCAAGCGCAATGAGCTGGCTGCCTTGGCACGAGGGGCGCTGGCGGGCATGGCTCAGCTGCGTGAGCTGTACCTCA
CCAGCAACCGACTGCGCAGCCGAGCCCTGGGCCCCGTGCCTGGGTGGACCTCGCCCATCTGCAGCTGCTGGACA
TCGCCGGGAATCAGCTCACAGAGATCCCCGAGGGGCTCCCCGAGTCACTTGAGTACCTGTACCTGCAGAACAACA
AGATTAGTGCGGTGCCCGCCAATGCCTTCGACTCCACGCCCAACCTCAAGGGGATCTTTCTCAGGTTTAACAAGC
TGGCTGTGGGCTCCGTGGTGGACAGTGCCTTCCGGAGGCTGAAGCACCTGCAGGTCTTGGACATTGAAGGCAACT
TAGAGTTTGGTGACATTTCCAAGGACCGTGGCCGCTTGGGGAAGGAAAAGGAGGAGGAGGAAGAGGAGGAGGAGG
AGGAAGAGGAAACAAGATAGTGACAAGGTGATGCAGATGTGACCTAGGATGATGGACCGCCGGACTCTTTTCTGC
AGCACACGCCTGTGTGCTGTGAGCCCCCACTCTGCCGTGCTCACACAGACACACCCAGCTGCACACATGAGGCA
TCCCACATGACACGGGCTGACACAGTCTCATATCCCCACCCCTTCCCACGGCGTGTCCCACGGCCAGACACATGC
ACACACATCACACCCTCAAACACCCAGCTCAGCCACACACAACTACCCTCCAAACCACCACAGTCTCTGTCACAC
CCCCACTACCGCTGCCACGCCCTCTGAATCATGCAGGGAAGGGTCTGCCCCTGCCCTGGCACACACAGGCACCCA
TTCCCTCCCCCTGCTGACATGTGTATGCGTATGCATACACACCACACACACACATGCACAAGTCATGTGCGAA
CAGCCCTCCAAAGCCTATGCCACAGACAGCTCTTGCCCCAGCCAGAATCAGCCATAGCAGCTCGCCGTCTGCCCT
GTCCATCTGTCCGTCCGTTCCCTGGAGAAGACACAAGGGTATCCATGCTCTGTGCCAGGTGCCTGCCACCCTCT
GGAACTCACAAAAGCTGGCTTTTATTCCTTTCCCATCCTATGGGGACAGGAGCCTTCAGGACTGCTGGCCTGGCC
TGGCCCACCCTGCTCCTCCAGGTGCTGGGCAGTCACTCTGCTAAGAGTCCCTCCCTGCCACGCCCTGGCAGGACA
CAGGCACTTTTCCAATGGGCAAGCCCAGTGGAGGCAGGATGGGAGAGCCCCCTGGGTGCTGCTGGGGCCTTGGGG
CAGGAGTGAAGCAGAGGTGATGGGGCTGGGCTGAGCCAGGGAGGAAGGACCCAGCTGCACCTAGGAGACACCTTT
GTTCTTCAGGCCTGTGGGGGAAGTTCCGGGTGCCTTTATTTTTTATTCTTTTCTAAGGAAAAAAATGATAAAAAT
CTCAAAGCTGATTTTTCTTGTTATAGAAAAACTAATATAAAAGCATTATCCCTATCCCTGCAAAAAAAAA
```

FIGURE 370

MEGEEAEQPAWFHQPWRPGASDSAPPAGTMAQSRVLLLLLLLPPQLHLGPVLAVRAPGFGRSG
GHSLSPEENEFAEEEPVLVLSPEEPGPGPAAVSCPRDCACSQEGVVDCGGIDLREFPGDLPEH
TNHLSLQNNQLEKIYPEELSRLHRLETLNLQNNRLTSRGLPEKAFEHLTNLNYLYLANNKLTL
APRFLPNALISVDFAANYLTKIYGLTFGQKPNLRSVYLHNNKLADAGLPDNMFNGSSNVEVLI
LSSNFLRHVPKHLPPALYKLHLKNNKLEKIPPGAFSELSSLRELYLQNNYLTDEGLDNETFWK
LSSLEYLDLSSNNLSRVPAGLPRSLVLLHLEKNAIRSVDANVLTPIRSLEYLLLHSNQLREQG
IHPLAFQGLKRLHTVHLYNNALERVPSGLPRRVRTLMILHNQITGIGREDFATTYFLEELNLS
YNRITSPQVHRDAFRKLRLLRSLDLSGNRLHTLPPGLPRNVHVLKVKRNELAALARGALAGMA
QLRELYLTSNRLRSRALGPRAWVDLAHLQLLDIAGNQLTEIPEGLPESLEYLYLQNNKISAVP
ANAFDSTPNLKGIFLRFNKLAVGSVVDSAFRRLKHLQVLDIEGNLEFGDISKDRGRLGKEKEE
EEEEEEEEEETR

Important features:
Signal sequence:
amino acids 1-48

N-glycosylation site.
amino acids 243-247, 310-314, 328-332, 439-443

Casein kinase II phosphorylation site.
amino acids 68-72, 84-88, 246-250, 292-296, 317-321, 591-595

N-myristoylation site.
amino acids 19-25, 107-113, 213-219, 217-223, 236-242, 335-341, 477-483, 498-502, 539-545, 548-554

Leucine zipper pattern.
amino acids 116-138, 251-273, 258-280, 322-344, 464-486, 471-493, 535-557

FIGURE 371

```
CACTTTCTCCCTCTCTTCCTTTACTTTCGAGAAACCGCGCTTCCGCTTCTGGTCGCAGAGACCTCGGAGACCGCG
CCGGGGAGACGGAGGTGCTGTGGGTGGGGGGGACCTGTGGCTGCTCGTACCGCCCCCACCCTCCTCTTCTGCAC
TGCCGTCCTCCGGAAGACCTTTTCCCCTGCTCTGTTTCCTTCACCGAGTCTGTGCATCGCCCCGGACCTGGCCGG
GAGGAGGCTTGGCCGGCGGGAGATGCTCTAGGGGCGGCGCGGGAGGAGCGGCCGGCGGGACGGAGGGCCCGGCAG
GAAGATGGGCTCCCGTGGACAGGGACTCTTGCTGGCGTACTGCCTGCTCCTTGCCTTTGCCTCTGGCCTGGTCCT
GAGTCGTGTGCCCCATGTCCAGGGGGAACAGCAGGAGTGGGAGGGGACTGAGGAGCTGCCGTCGCCTCCGGACCA
TGCCGAGAGGGCTGAAGAACAACATGAAAAATACAGGCCCAGTCAGGACCAGGGGCTCCCTGCTTCCGGTGCTT
GCGCTGCTGTGACCCCGGTACCTCCATGTACCCGGCGACCGCCGTGCCCCAGATCAACATCACTATCTTGAAAGG
GGAGAAGGGTGACCGCGGAGATCGAGGCCTCCAAGGGAAATATGGCAAAACAGGCTCAGCAGGGGCCAGGGGCCA
CACTGGACCCAAAGGGCAGAAGGGCTCCATGGGGGCCCCTGGGGAGCGGTGCAAGAGCCACTACGCCGCCTTTTC
GGTGGGCCGGAAGAAGCCCATGCACAGCAACCACTACTACCAGACGGTGATCTTCGACACGGAGTTCGTGAACCT
CTACGACCACTTCAACATGTTCACCGGCAAGTTCTACTGCTACGTGCCCGGCCTCTACTTCTTCAGCCTCAACGT
GCACACCTGGAACCAGAAGGAGACCTACCTGCACATCATGAAGAACGAGGAGGAGGTGGTGATCTTGTTCGCGCA
GGTGGGCGACCGCAGCATCATGCAAAGCCAGAGCCTGATGCTGGAGCTGCGAGAGCAGGACCAGGTGTGGGTACG
CCTCTACAAGGGCGAACGTGAGAACGCCATCTTCAGCGAGGAGCTGGACACCTACATCACCTTCAGTGGCTACCT
GGTCAAGCACGCCACCGAGCCCTAGCTGGCCGGCCACCTCCTTTCCTCTCGCCACCTTCCACCCCTGCGCTGTGC
TGACCCCACCGCCTCTTCCCCGATCCCTGGACTCCGACTCCCTGGCTTTGGCATTCAGTGAGACGCCCTGCACAC
ACAGAAAGCCAAAGCGATCGGTGCTCCCAGATCCCGCAGCCTCTGGAGAGAGCTGACGGCAGATGAAATCACCAG
GGCGGGGCACCCGCGAGAACCCTCTGGGACCTTCCGCGGCCCTCTCTGCACACATCCTCAAGTGACCCCGCACGG
CGAGACGCGGGTGGCGGCAGGGCGTCCCAGGGTGCGGCACCGCGGCTCCAGTCCTTGGAAATAATTAGGCAAATT
CTAAAGGTCTCAAAAGGAGCAAAGTAAACCGTGGAGGACAAAGAAAAGGGTTGTTATTTTGTCTTTCCAGCCAG
CCTGCTGGCTCCCAAGAGAGAGGCCTTTTCAGTTGAGACTCTGCTTAAGAGAAGATCCAAAGTTAAAGCTCTGGG
GTCAGGGGAGGGGCCGGGGGCAGGAAACTACCTCTGGCTTAATTCTTTTAAGCCACGTAGGAACTTTCTTGAGGG
ATAGGTGGACCCTGACATCCCTGTGGCCTTGCCCAAGGGCTCTGCTGGTCTTTCTGAGTCACAGCTGCGAGGTGA
TGGGGGCTGGGGCCCCAGGCGTCAGCCTCCCAGAGGGACAGCTGAGCCCCCCTGCCTTGGCTCCAGGTTGGTAGAA
GCAGCCGAAGGGCTCCTGACAGTGGCCAGGGACCCCTGGGTCCCCCAGGCCTGCAGATGTTTCTATGAGGGCAG
AGCTCCTTGGTACATCCATGTGTGGCTCTGCTCCACCCCTGTGCCACCCCAGAGCCCTGGGGGGTGGTCTCCATG
CCTGCCACCCTGGCATCGGCTTTCTGTGCCGCCTCCCACACAAATCAGCCCCAGAAGGCCCCGGGGCCTTGGCTT
CTGTTTTTTATAAAACACCTCAAGCAGCACTGCAGTCTCCCATCTCCTCGTGGGCTAAGCATCACCGCTTCCACG
TGTGTTGTGTTGGTTGGCAGCAAGGCTGATCCAGACCCCTTCTGCCCCACTGCCCTCATCCAGGCCTCTGACCA
GTAGCCTGAGAGGGCTTTTTCTAGGCTTCAGAGCAGGGGAGAGCTGGAAGGGGCTAGAAAGCTCCCGCTTGTCT
GTTTCTCAGGCTCCTGTGAGCCTCAGTCCTGAGACCAGAGTCAAGAGGAAGTACACGTCCCAATCACCCGTGTCA
GGATTCACTCTCAGGAGCTGGGTGGCAGGAGAGGCAATAGCCCCTGTGGCAATTGCAGGACCAGCTGGAGCAGGG
TTGCGGTGTCTCCACGGTGCTCTCGCCCTGCCCATGGCCACCCCAGACTCTGATCTCCAGGAACCCCATAGCCCC
TCTCCACCTCACCCCATGTTGATGCCCAGGGTCACTCTTGCTACCCGCTGGGCCCCAAACCCCCGCTGCCTCTC
TTCCTTCCCCCCATCCCCCACCTGGTTTTGACTAATCCTGCTTCCCTCTCTGGGCCTGGCTGCCGGGATCTGGGG
TCCCTAAGTCCCTCTCTTTAAAGAACTTCTGCGGGTCAGACTCTGAAGCCGAGTTGCTGTGGGCGTGCCCGGAAG
CAGAGCGCCACACTCGCTGCTTAAGCTCCCCCAGCTCTTTCCAGAAAACATTAAACTCAGAATTGTGTTTTCAA
```

FIGURE 372

MGSRGQGLLLAYCLLLAFASGLVLSRVPHVQGEQQEWEGTEELPSPPDHAERAEEQHEKYRPS
QDQGLPASRCLRCCDPGTSMYPATAVPQINITILKGEKGDRGDRGLQGKYGKTGSAGARGHTG
PKGQKGSMGAPGERCKSHYAAFSVGRKKPMHSNHYYQTVIFDTEFVNLYDHFNMFTGKFYCYV
PGLYFFSLNVHTWNQKETYLHIMKNEEEVVILFAQVGDRSIMQSQSLMLELREQDQVWVRLYK
GERENAIFSEELDTYITFSGYLVKHATEP

Important features:
Signal sequence.
amino acids 1-25

N-glycosylation site.
amino acids 93-97

N-myristoylation sites.
amino acids 7-13, 21-27, 67-73, 117-123, 129-135

Amidation site.
amino acids 150-154

Cell attachment sequence.
amino acids 104-107

FIGURE 373

CGGAGTGGTGCGCCAACGTGAGAGGAAACCCGTGCGCGGCTGCGCTTTCCTGTCCCCAAGCCG
TTCTAGACGCGGGAAAAATGCTTTCTGAAAGCAGCTCCTTTTTGAAGGGTGTGATGCTTGGAA
GCATTTTCTGTGCTTTGATCACTATGCTAGGACACATTAGGATTGGTCATGGAAATAGAATGC
ACCACCATGAGCATCATCACCTACAAGCTCCTAACAAAGAAGATATCTTGAAATTTCAGAGG
ATGAGCGCATGGAGCTCAGTAAGAGCTTTCGAGTATACTGTATTATCCTTGTAAAACCCAAAG
ATGTGAGTCTTTGGGCTGCAGTAAAGGAGACTTGGACCAAACACTGTGACAAAGCAGAGTTCT
TCAGTTCTGAAAATGTTAAAGTGTTTGAGTCAATTAATATGGACACAAATGACATGTGGTTAA
TGATGAGAAAAGCTTACAAATACGCCTTTGATAAGTATAGAGACCAATACAACTGGTTCTTCC
TTGCACGCCCCACTACGTTTGCTATCATTGAAAACCTAAAGTATTTTTGTTAAAAAGGATC
CATCACAGCCTTTCTATCTAGGCCACACTATAAATCTGGAGACCTTGAATATGTGGGTATGG
AAGGAGGAATTGTCTTAAGTGTAGAATCAATGAAAAGACTTAACAGCCTTCTCAATATCCCAG
AAAAGTGTCCTGAACAGGGAGGGATGATTTGGAAGATATCTGAAGATAAACAGCTAGCAGTTT
GCCTGAAATATGCTGGAGTATTTGCAGAAATGCAGAAGATGCTGATGGAAAGATGTATTTA
ATACCAAATCTGTTGGGCTTTCTATTAAAGAGGCAATGACTTATCACCCCAACCAGGTAGTAG
AAGGCTGTTGTTCAGATATGGCTGTTACTTTTAATGGACTGACTCCAAATCAGATGCATGTGA
TGATGTATGGGGTATACCGCCTTAGGGCATTTGGGCATATTTTCAATGATGCATTGGTTTTCT
TACCTCCAAATGGTTCTGACAATGACTGAGAAGTGGTAGAAAAGCGTGAATATGATCTTTGTA
TAGGACGTGTGTTGTCATTATTTGTAGTAGTAACTACATATCCAATACAGCTGTATGTTTCTT
TTTCTTTTCTAATTTGGTGGCACTGGTATAACCACACATTAAAGTCAGTAGTACATTTTTAAA
TGAGGGTGGTTTTTTTCTTTAAAACACATGAACATTGTAAATGTGTTGGAAAGAAGTGTTTTA
AGAATAATAATTTTGCAAATAAACTATTAATAAATATTATATGTGATAAATTCTAAATTATGA
ACATTAGAAATCTGTGGGGCACATATTTTTGCTGATTGGTTAAAAAATTTTAACAGGTCTTTA
GCGTTCTAAGATATGCAAATGATATCTCTAGTTGTGAATTTGTGATTAAAGTAAAACTTTTAG
CTGTGTGTTCCCTTTACTTCTAATACTGATTTATGTTCTAAGCCTCCCCAAGTTCCAATGGAT
TTGCCTTCTCAAAATGTACAACTAAGCAACTAAAGAAATTAAAGTGAAAGTTGAAAAAT

FIGURE 374

MLSESSSFLKGVMLGSIFCALITMLGHIRIGHGNRMHHHEHHHLQAPNKEDILKISEDERMELSKSFRVYCIILV
KPKDVSLWAAVKETWTKHCDKAEFFSSENVKVFESINMDTNDMWLMMRKAYKYAFDKYRDQYNWFFLARPTTFAI
IENLKYFLLKKDPSQPFYLGHTIKSGDLEYVGMEGGIVLSVESMKRLNSLLNIPEKCPEQGGMIWKISEDKQLAV
CLKYAGVFAENAEDADGKDVFNTKSVGLSIKEAMTYHPNQVVEGCCSDMAVTFNGLTPNQMHVMMYGVYRLRAFG
HIFNDALVFLPPNGSDND

Important features:
Signal sequence:
amino acids 1-33

N-glycosylation site.
amino acids 121-125, 342-346 cAMP- and cGMP-dependent protein kinase phosphorylation site.
amino acids 319-323, 464-468

Casein kinase II phosphorylation site.
amino acids 64-132, 150-154, 322-326, 331-335, 368-372, 385-389, 399-403, 409-413, 473-477, 729-733, 748-752

Tyrosine kinase phosphorylation site.
amino acids 736-743

N-myristoylation site.
amino acids 19-25, 23-29, 136-142, 397-403, 441-447, 544-550, 558-564, 651-657, 657-663, 672-672

Prokaryotic membrane lipoprotein lipid attachment site.
amino acids 14-25

Cell attachment sequence.
amino acids 247-250

FIGURE 375

GTTGTGTCCTTCAGCAAAACAGTGGATTTAAATCTCCTTGCACAAGCTTGAGAGCAACACAAT
CTATCAGGAAAGAAAGAAAGAAAAAAACCGAACCTGACAAAAAAGAAGAAAAAGAAGAAGAAA
AAAAATC<u>ATG</u>AAAACCATCCAGCCAAAAATGCACAATTCTATCTCTTGGGCAATCTTCACGGG
GCTGGCTGCTCTGTGTCTCTTCCAAGGAGTGCCCGTGCGCAGCGGAGATGCCACCTTCCCCAA
AGCTATGGACAACGTGACGGTCCGGCAGGGGAGAGCGCCACCCTCAGGTGCACTATTGACAA
CCGGGTCACCCGGGTGGCCTGGCTAAACCGCAGCACCATCCTCTATGCTGGGAATGACAAGTG
GTGCCTGGATCCTCGCGTGGTCCTTCTGAGCAACACCCAAACGCAGTACAGCATCGAGATCCA
GAACGTGGATGTGTATGACGAGGGCCCTTACACCTGCTCGGTGCAGACAGACAACCACCCAAA
GACCTCTAGGGTCCACCTCATTGTGCAAGTATCTCCCAAAATTGTAGAGATTTCTTCAGATAT
CTCCATTAATGAAGGGAACAATATTAGCCTCACCTGCATAGCAACTGGTAGACCAGAGCCTAC
GGTTACTTGGAGACACATCTCTCCCAAAGCGGTTGGCTTTGTGAGTGAAGACGAATACTTGGA
AATTCAGGGCATCACCCGGGAGCAGTCAGGGGACTACGAGTGCAGTGCCTCCAATGACGTGGC
CGCGCCCGTGGTACGGAGAGTAAAGGTCACCGTGAACTATCCACCATACATTTCAGAAGCCAA
GGGTACAGGTGTCCCCGTGGGACAAAAGGGGACACTGCAGTGTGAAGCCTCAGCAGTCCCCTC
AGCAGAATTCCAGTGGTACAAGGATGACAAAAGACTGATTGAAGGAAAGAAAGGGGTGAAAGT
GGAAAACAGACCTTTCCTCTCAAAACTCATCTTCTTCAATGTCTCTGAACATGACTATGGGAA
CTACACTTGCGTGGCCTCCAACAAGCTGGGCCACACCAATGCCAGCATCATGCTATTTGGTCC
AGGCGCCGTCAGCGAGGTGAGCAACGGCACGTCGAGGAGGGCAGGCTGCGTCTGGCTGCTGCC
TCTTCTGGTCTTGCACCTGCTTCTCAAATTT<u>TGA</u>TGTGAGTGCCACTTCCCCACCCGGGAAAG
GCTGCCGCCACCACCACCACCAACACAACAGCAATGGCAACACCGACAGCAACCAATCAGATA
TATACAAATGAAATTAGAAGAAACACAGCCTCATGGGACAGAAATTTGAGGGAGGGGAACAAA
GAATACTTTGGGGGGAAAAGAGTTTTAAAAAAGAAATTGAAAATTGCCTTGCAGATATTTAGG
TACAATGGAGTTTTCTTTTCCCAAACGGGAAGAACACAGCACACCCGGCTTGGACCCACTGCA
AGCTGCATCGTGCAACCTCTTTGGTGCCAGTGTGGGCAAGGGCTCAGCCTCTCTGCCCACAGA
GTGCCCCCACGTGGAACATTCTGGAGCTGGCCATCCCAAATTCAATCAGTCCATAGAGACGAA
CAGAATGAGACCTTCCGGCCCAAGCGTGGCGCTGCGGGCACTTTGGTAGACTGTGCCACCACG
GCGTGTGTTGTGAAACGTGAAATAAAAGAGCAAAAAAAAA

FIGURE 376

MKTIQPKMHNSISWAIFTGLAALCLFQGVPVRSGDATFPKAMDNVTVRQGESATLRCTIDNRV
TRVAWLNRSTILYAGNDKWCLDPRVVLLSNTQTQYSIEIQNVDVYDEGPYTCSVQTDNHPKTS
RVHLIVQVSPKIVEISSDISINEGNNISLTCIATGRPEPTVTWRHISPKAVGFVSEDEYLEIQ
GITREQSGDYECSASNDVAAPVVRRVKVTVNYPPYISEAKGTGVPVGQKGTLQCEASAVPSAE
FQWYKDDKRLIEGKKGVKVENRPFLSKLIFFNVSEHDYGNYTCVASNKLGHTNASIMLFGPGA
VSEVSNGTSRRAGCVWLLPLLVLHLLLKF

Important features:
Signal peptide:
amino acids 1-28

FIGURE 377

```
CTTCTTTGAAAAGGATTATCACCTGATCAGGTTCTCTCTGCATTTGCCCCTTTAGATTGTGAA
ATGTGGCTCAAGGTCTTCACAACTTTCCTTTCCTTTGCAACAGGTGCTTGCTCGGGGCTGAAG
GTGACAGTGCCATCACACACTGTCCATGGCGTCAGAGGTCAGGCCCTCTACCTACCCGTCCAC
TATGGCTTCCACACTCCAGCATCAGACATCCAGATCATATGGCTATTTGAGAGACCCCACACA
ATGCCCAAATACTTACTGGGCTCTGTGAATAAGTCTGTGGTTCCTGACTTGGAATACCAACAC
AAGTTCACCATGATGCCACCCAATGCATCTCTGCTTATCAACCCACTGCAGTTCCCTGATGAA
GGCAATTACATCGTGAAGGTCAACATTCAGGGAAATGGAACTCTATCTGCCAGTCAGAAGATA
CAAGTCACGGTTGATGATCCTGTCACAAAGCCAGTGGTGCAGATTCATCCTCCCTCTGGGGCT
GTGGAGTATGTGGGGAACATGACCCTGACATGCCATGTGGAAGGGGGCACTCGGCTAGCTTAC
CAATGGCTAAAAATGGGAGACCTGTCCACACCAGCTCCACCTACTCCTTTTCTCCCCAAAAC
AATACCCTTCATATTGCTCCAGTAACCAAGGAAGACATTGGGAATTACAGCTGCCTGGTGAGG
AACCCTGTCAGTGAAATGGAAAGTGATATCATTATGCCCATCATATATTATGGACCTTATGGA
CTTCAAGTGAATTCTGATAAAGGGCTAAAAGTAGGGGAAGTGTTTACTGTTGACCTTGGAGAG
GCCATCCTATTTGATTGTTCTGCTGATTCTCATCCCCCCAACACCTACTCCTGGATTAGGAGG
ACTGACAATACTACATATATCATTAAGCATGGGCCTCGCTTAGAAGTTGCATCTGAGAAAGTA
GCCCAGAAGACAATGGACTATGTGTGCTGTGCTTACAACAACATAACCGGCAGGCAAGATGAA
ACTCATTTCACAGTTATCATCACTTCCGTAGGACTGGAGAAGCTTGCACAGAAAGGAAAATCA
TTGTCACCTTTAGCAAGTATAACTGGAATATCACTATTTTTGATTATATCCATGTGTCTTCTC
TTCCTATGGAAAAAATATCAACCCTACAAAGTTATAAAACAGAAACTAGAAGGCAGGCCAGAA
ACAGAATACAGGAAAGCTCAAACATTTTCAGGCCATGAAGATGCTCTGGATGACTTCGGAATA
TATGAATTTGTTGCTTTTCCAGATGTTTCTGGTGTTTCCAGGATTCCAAGCAGGTCTGTTCCA
GCCTCTGATTGTGTATCGGGGCAAGATTTGCACAGTACAGTGTATGAAGTTATTCAGCACATC
CCTGCCCAGCAGCAAGACCATCCAGAGTGAACTTTCATGGGCTAAACAGTACATTCGAGTGAA
ATTCTGAAGAAACATTTTAAGGAAAAACAGTGGAAAGTATATTAATCTGGAATCAGTGAAGA
AACCAGGACCAACACCTCTTACTCATTATTCCTTTACATGCAGAATAGAGGCATTTATGCAAA
TTGAACTGCAGGTTTTTCAGCATATACACAATGTCTTGTGCAACAGAAAAACATGTTGGGGAA
ATATTCCTCAGTGGAGAGTCGTTCTCATGCTGACGGGGAGAACGAAAGTGACAGGGGTTTCCT
CATAAGTTTTGTATGAAATATCTCTACAAACCTCAATTAGTTCTACTCTACACTTTCACTATC
ATCAACACTGAGACTATCCTGTCTCACCTACAAATGTGGAAACTTTACATTGTTCGATTTTTC
AGCAGACTTTGTTTTATTAAATTTTATTAGTGTTAAGAATGCTAAATTTATGTTTCAATTTT
ATTTCCAAATTTCTATCTTGTTATTTGTACAACAAAGTAATAAGGATGGTTGTCACAAAAACA
AAACTATGCCTTCTCTTTTTTTCAATCACCAGTAGTATTTTGAGAAGACTTGTGAACACTT
AAGGAAATGACTATTAAAGTCTTATTTTATTTTTTCAAGGAAGATGGATTCAAATAAATT
ATTCTGTTTTTGCTTTTAAAAAAAAAAAAAAA
```

FIGURE 378

MWLKVFTTFLSFATGACSGLKVTVPSHTVHGVRGQALYLPVHYGFHTPASDIQIIWLFERPHTMPKYLLGSVNKS
VVPDLEYQHKFTMMPPNASLLINPLQFPDEGNYIVKVNIQGNGTLSASQKIQVTVDDPVTKPVVQIHPPSGAVEY
VGNMTLTCHVEGGTRLAYQWLKNGRPVHTSSTYSFSPQNNTLHIAPVTKEDIGNYSCLVRNPVSEMESDIIMPII
YYGPYGLQVNSDKGLKVGEVFTVDLGEAILFDCSADSHPPNTYSWIRRTDNTTYIIKHGPRLEVASEKVAQKTMD
YVCCAYNNITGRQDETHFTVIITSVGLEKLAQKGKSLSPLASITGISLFLIISMCLLFLWKKYQPYKVIKQKLEG
RPETEYRKAQTFSGHEDALDDFGIYEFVAFPDVSGVSRIPSRSVPASDCVSGQDLHSTVYEVIQHIPAQQQDHPE

Important features:
Signal sequence:
amino acids 1-18

Transmembrane domain:
amino acids 341-359

N-glycosylation site.
amino acids 73-77, 92-96, 117-121, 153-157, 189-193, 204-208, 276-280, 308-312

Casein kinase II phosphorylation site.
amino acids 129-133, 198-202, 214-218, 388-392, 426-430, 433-437

Tyrosine kinase phosphorylation site.
amino acids 272-280

N-myristoylation site.
amino acids 15-21, 19-25, 118-124, 163-167, 203-209, 231-237, 239-245

Prokaryotic membrane lipoprotein lipid attachment site.
amino acids 7-18

FIGURE 379

ATAGTAGAAGAATGTCTCTGAAATTACTGGATGAGTTTCAGTCATACTTTCACATGGGCACAA
TTTCACATTCAAGCTCCTTATCCTAGGCTAATTTTATATTATGTTAAATCACTTGTTTTTGTT
CTCACGGCTTCCTGCCTGCTATAGGCATAATTACGAGGAAGCAGAACTTCTCCAGAAGCAAGC
GCACATGCGTTCCAAAATAAGAGCAAATTCGCTCTAAACACAGGAAAAGACCTGAAGCTTTAA
TTAAGGGGTTACATCCAACCCCAGAGCGCTTTTGTGGGCACTGATTGCTCCAGCTTCTGCGTC
ACTGCGCGAGGGAAGAGGGAAGAGGATCCAGGCGTTAGACATGTATAGACACAAAAACAGCTG
GAGATTGGGCTTAAAATACCCACCAAGCTCCAAAGAAGAGACCCAAGTCCCCAAAACATTGAT
TTCAGGGCTGCCAGGAAGGAAGAGCAGCAGCAGGGTGGGAGAGAAGCTCCAGTCAGCCCACAA
GATGCCATTGTCCCCCGGCCTCCTGCTGCTGCTGCTCTCCGGGGCCACGGCCACCGCTGCCCT
GCCCCTGGAGGGTGGCCCCACCGGCCGAGACAGCGAGCATATGCAGGAAGCGGCAGGAATAAG
GAAAAGCAGCCTCCTGACTTTCCTCGCTTGGTGGTTTGAGTGGACCTCCCAGGCCAGTGCCGG
GCCCCTCATAGGAGAGGAAGCTCGGGAGGTGGCCAGGCGGCAGGAAGGCGCACCCCCCAGCA
ATCCGCGCCGGGACAGAATGCCCTGCAGGAACTTCTTCTGGAAGACCTTCTCCTCCTGCAA
ATAG

FIGURE 380

MYRHKNSWRLGLKYPPSSKEETQVPKTLISGLPGRKSSSRVGEKLQSAHKMPLSPGLLLLLLS
GATATAALPLEGGPTGRDSEHMQEAAGIRKSSLLTFLAWWFEWTSQASAGPLIGEEAREVARR
QEGAPPQQSARRDRMPCRNFFWKTFSSCK

Important features:

Transmembrane domain:

amino acids 51-69 cAMP- and cGMP-dependent protein kinase phosphorylation sites.

amino acids 35-39, 92-96

N-myristoylation sites.

amino acids 64-70, 75-81, 90-96

Amidation site.

amino acids 33-37

FIGURE 381

```
GGCGCCGGTGCACCGGGCGGGCTGAGCGCCTCCTGCGGCCCGGCCTGCGCGCCCCGGCCCGCC
GCGCCGCCCACGCCCCAACCCCGGCCCGCGCCCCTAGCCCCCGCCCGGGCCCGCGCCCGCGC
CCGCGCCCAGGTGAGCGCTCCGCCCGCCGCGAGGCCCCGCCCCGGCCCGCCCCCGCCCCGCCC
CGGCCGGCGGGGGAACCGGGCGGATTCCTCGCGCGTCAAACCACCTGATCCCATAAAACATTC
ATCCTCCCGGCGGCCCGCGCTGCGAGCGCCCCGCCAGTCCGCGCCGCCGCCGCCCTCGCCCTG
TGCGCCCTGCGCGCCCTGCGCACCCGCGGCCCGAGCCCAGCCAGAGCCGGGCGGAGCGGAGCG
CGCCGAGCCTCGTCCCGCGGCCGGGCCGGGGCCGGGCCGTAGCGGCGGCGCCTGGATGCGGAC
CCGGCCGCGGGGAGACGGGCGCCCGCCCCGAAACGACTTTCAGTCCCCGACGCGCCCCGCCCA
ACCCCTACGATGAAGAGGGCGTCCGCTGGAGGGAGCCGGCTGCTGGCATGGGTGCTGTGGCTG
CAGGCCTGGCAGGTGGCAGCCCCATGCCCAGGTGCCTGCGTATGCTACAATGAGCCCAAGGTG
ACGACAAGCTGCCCCCAGCAGGGCCTGCAGGCTGTGCCCGTGGGCATCCCTGCTGCCAGCCAG
CGCATCTTCCTGCACGGCAACCGCATCTCGCATGTGCCAGCTGCCAGCTTCCGTGCCTGCCGC
AACCTCACCATCCTGTGGCTGCACTCGAATGTGCTGGCCCGAATTGATGCGGCTGCCTTCACT
GGCCTGGCCCTCCTGGAGCAGCTGGACCTCAGCGATAATGCACAGCTCCGGTCTGTGGACCCT
GCCACATTCCACGGCCTGGGCCGCCTACACACGCTGCACCTGGACCGCTGCGGCCTGCAGGAG
CTGGGCCCGGGGCTGTTCCGCGGCCTGGCTGCCCTGCAGTACCTCTACCTGCAGGACAACGCG
CTGCAGGCACTGCCTGATGACACCTTCCGCGACCTGGGCAACCTCACACACCTCTTCCTGCAC
GGCAACCGCATCTCCAGCGTGCCCGAGCGCGCCTTCCGTGGGCTGCACAGCCTCGACCGTCTC
CTACTGCACCAGAACCGCGTGGCCCATGTGCACCCGCATGCCTTCCGTGACCTTGGCCGCCTC
ATGACACTCTATCTGTTTGCCAACAATCTATCAGCGCTGCCCACTGAGGCCCTGGCCCCCCTG
CGTGCCCTGCAGTACCTGAGGCTCAACGACAACCCCTGGGTGTGTGACTGCCGGGCACGCCCA
CTCTGGGCCTGGCTGCAGAAGTTCCGCGGCTCCTCCTCCGAGGTGCCCTGCAGCCTCCCGCAA
CGCCTGGCTGGCCGTGACCTCAAACGCCTAGCTGCCAATGACCTGCAGGGCTGCGCTGTGGCC
ACCGGCCCTTACCATCCCATCTGGACCGGCAGGGCCACCGATGAGGAGCCGCTGGGGCTTCCC
AAGTGCTGCCAGCCAGATGCCGCTGACAAGGCCTCAGTACTGGAGCCTGGAAGACCAGCTTCG
GCAGGCAATGCGCTGAAGGGACGCGTGCCGCCCGGTGACAGCCCGCCGGGCAACGGCTCTGGC
CCACGGCACATCAATGACTCACCCTTTGGGACTCTGCCTGGCTCTGCTGAGCCCCGCTCACT
GCAGTGCGGCCCGAGGGCTCCGAGCCACCAGGGTTCCCCACCTCGGGCCCTCGCCGGAGGCCA
GGCTGTTCACGCAAGAACCGCACCCGCAGCCACTGCCGTCTGGGCCAGGCAGGCAGCGGGGT
GGCGGGACTGGTGACTCAGAAGGCTCAGGTGCCCTACCCAGCCTCACCTGCAGCCTCACCCCC
CTGGGCCTGGCGCTGGTGCTGTGGACAGTGCTTGGGCCCTGCTGACCCCCAGCGGACACAAGA
GCGTGCTCAGCAGCCAGGTGTGTGTACATACGGGTCTCTCTCCACGCCGCCAAGCCAGCCGG
GCGGCCGACCCGTGGGGCAGGCCAGGCAGGTCCTCCCTGATGGACGCCTGCCGCCCGCCACC
CCCATCTCCACCCCATCATGTTTACAGGGTTCGGCGGCAGCGTTTGTTCCAGAACGCCGCCTC
CCACCCAGATCGCGGTATATAGAGATATGCATTTTATTTTACTTGTGTAAAAATATCGGACGA
CGTGGAATAAAGAGCTCTTTTCTTAAAAAAA
```

FIGURE 382

MKRASAGGSRLLAWVLWLQAWQVAAPCPGACVCYNEPKVTTSCPQQGLQAVPVGIPAASQRIF
LHGNRISHVPAASFRACRNLTILWLHSNVLARIDAAAFTGLALLEQLDLSDNAQLRSVDPATF
HGLGRLHTLHLDRCGLQELGPGLFRGLAALQYLYLQDNALQALPDDTFRDLGNLTHLFLHGNR
ISSVPERAFRGLHSLDRLLLHQNRVAHVHPHAFRDLGRLMTLYLFANNLSALPTEALAPLRAL
QYLRLNDNPWVCDCRARPLWAWLQKFRGSSSEVPCSLPQRLAGRDLKRLAANDLQGCAVATGP
YHPIWTGRATDEEPLGLPKCCQPDAADKASVLEPGRPASAGNALKGRVPPGDSPPGNGSGPRH
INDSPFGTLPGSAEPPLTAVRPEGSEPPGFPTSGPRRRPGCSRKNRTRSHCRLGQAGSGGGGT
GDSEGSGALPSLTCSLTPLGLALVLWTVLGPC

Important features:

Signal peptide:

amino acids 1-26

Leucine zipper pattern.

amino acids 135-156

Glycosaminoglycan attachment site.

amino acids 436-439

N-glycosylation site.

amino acids 82-85, 179-183, 237-240, 372-375 and 423-426

VWFC domain amino acids 411-425

FIGURE 383

```
TTCGTGACCCTTGAGAAAAGAGTTGGTGGTAAATGTGCCACGTCTTCTAAGAAGGGGGAGTCCTGAACTTGTCTG
AAGCCCTTGTCCGTAAGCCTTGAACTACGTTCTTAAATCTATGAAGTCGAGGGACCTTTCGCTGCTTTTGTAGGG
ACTTCTTTCCTTGCTTCAGCAACATGAGGCTTTTCTTGTGGAACGCGGTCTTGACTCTGTTCGTCACTTCTTTGA
TTGGGGCTTTGATCCCTGAACCAGAAGTGAAAATTGAAGTTCTCCAGAAGCCATTCATCTGCCATCGCAAGACCA
AAGGAGGGGATTTGATGTTGGTCCACTATGAAGCTACTTAGAAAAGGACGGCTCCTTATTTCACTCCACTCACA
AACATAACAATGGTCAGCCCATTTGGTTTACCCTGGGCATCCTGGAGGCTCTCAAAGGTTGGGACCAGGGCTTGA
AAGGAATGTGTGTAGGAGAGAAGAGAAAGCTCATCATTCCTCCTGCTCTGGGCTATGGAAAAGAAGGAAAAGGTA
AAATTCCCCCAGAAAGTACACTGATATTTAATATTGATCTCCTGGAGATTCGAAATGGACCAAGATCCCATGAAT
CATTCCAAGAAATGGATCTTAATGATGACTGGAAACTCTCTAAAGATGAGGTTAAAGCATATTTAAAGAAGGAGT
TTGAAAAACATGGTGCGGTGGTGAATGAAAGTCATCATGATGCTTTGGTGGAGGATATTTTTGATAAAGAAGATG
AAGACAAAGATGGGTTTATATCTGCCAGAGAATTTACATATAAACACGATGAGTTATAGAGATACATCTACCCTT
TTAATATAGCACTCATCTTTCAAGAGAGGGCAGTCATCTTTAAAGAACATTTTATTTTTATACAATGTTCTTTCT
TGCTTTGTTTTTTATTTTTATATATTTTTCTGACTCCTATTTAAAGAACCCCTTAGGTTTCTAAGTACCCATTT
CTTTCTGATAAGTTATTGGGAAGAAAAAGCTAATTGGTCTTTGAATAGAAGACTTCTGGACAATTTTTCACTTTC
ACAGATATGAAGCTTTGTTTTACTTTCTCACTTATAAATTTAAAATGTTGCAACTGGGAATATACCACGACATGA
GACCAGGTTATAGCACAAATTAGCACCCTATATTTCTGCTTCCCTCTATTTTCTCCAAGTTAGAGGTCAACATTT
GAAAAGCCTTTTGCAATAGCCCAAGGCTTGCTATTTTCATGTTATAATGAAATAGTTTATGTGTAACTGGCTCTG
AGTCTCTGCTTGAGGACCAGAGGAAAATGGTTGTTGGACCTGACTTGTTAATGGCTACTGCTTTACTAAGGAGAT
GTGCAATGCTGAAGTTAGAAACAAGGTTAATAGCCAGGCATGGTGGCTCATGCCTGTAATCCCAGCACTTTGGGA
GGCTGAGGCGGGCGGATCACCTGAGGTTGGGAGTTCGAGACCAGCCTGACCAACACGGAGAAACCCTATCTCTAC
TAAAAATACAAAGTAGCCCGGCGTGGTGATGCGTGCCTGTAATCCCAGCTACCCAGGAAGGCTGAGGCGGCAGAA
TCACTTGAACCCGAGGCCGAGGTTGCGGTAAGCCGAGATCACCTNCAGCCTGGACACTCTGTCTCGAAAAAAGAA
AAGAACACGGTTAATACCATATNAATATGTATGCATTGAGACATGCTACCTAGGACTTAAGCTGATGAAGCTTGG
CTCCTAGTGATTGGTGGCCTATTATGATAAATAGGACAAATCATTTATGTGTGAGTTTCTTTGTAATAAAATGTA
TCAATATGTTATAGATGAGGTAGAAAGTTATATTTATATTCAATATTTACTTCTTAAGGCTAGCGGAATATCCTT
CCTGGTTCTTTAATGGGTAGTCTATAGTATATTATACTACAATAACATTGTATCATAAGATAAAGTAGTAAACCA
GTCTACATTTTCCCATTTCTGTCTCATCAAAAACTGAAGTTAGCTGGGTGTGGTGGCTCATGCCTGTAATCCCAG
CACTTTGGGGGCCAAGGAGGGTGGATCACTTGAGATCAGGAGTTCAAGACCAGCCTGGCCAACATGGTGAAACCT
TGTCTCTACTAAAAATACAAAAATTAGCCAGGCGTGGTGGTGCACACCTGTAGTCCCAGCTACTCGGGAGGCTGA
GACAGGAGATTTGCTTGAACCCGGGAGGCGGAGGTTGCAGTGAGCCAAGATTGTGCCACTGCACTCCAGCCTGGG
TGACAGAGCAAGACTCCATCTCAAAAAAAAAAAAAAGAAGCAGACCTACAGCAGCTACTATTGAATAAATACCTA
TCCTGGATTTT
```

FIGURE 384

MRLFLWNAVLTLFVTSLIGALIPEPEVKIEVLQKPFICHRKTKGGDLMLVHYEGYLEKDGSLF
HSTHKHNNGQPIWFTLGILEALKGWDQGLKGMCVGEKRKLIIPPALGYGKEGKGKIPPESTLI
FNIDLLEIRNGPRSHESFQEMDLNDDWKLSKDEVKAYLKKEFEKHGAVVNESHHDALVEDIFD
KEDEDKDGFISAREFTYKHDEL

Important features:

Signal peptide:

amino acids 1-20

N-glycosylation site.

amino acids 176-179

Casein kinase II phosphorylation site.

amino acids 143-146, 156-159, 178-181 and 200-203

Endoplasmic reticulum targeting sequence.

amino acids 208-211

FKBP-type peptidyl-prolyl cis-trans isomerase amino acids 78-114 and 118-131

EF-hand calcium-binding domain.

amino acids 191-203, 184-203 and 140-159

S-100/ICaBP type calcium binding domain amino acids 183-203

FIGURE 385

```
CTCCCACGGTGTCCAGCGCCCAGAATGCGGCTTCTGGTCCTGCTATGGGGTTGCCTGCTGCTC
CCAGGTTATGAAGCCCTGGAGGGCCCAGAGGAAATCAGCGGGTTCGAAGGGGACACTGTGTCC
CTGCAGTGCACCTACAGGGAAGAGCTGAGGGACCACCGGAAGTACTGGTGCAGGAAGGGTGGG
ATCCTCTTCTCTCGCTGCTCTGGCACCATCTATGCAGAAGAAGAAGGCCAGGAGACAATGAAG
GGCAGGGTGTCCATCCGTGACAGCCGCCAGGAGCTCTCGCTCATTGTGACCCTGTGGAACCTC
ACCCTGCAAGACGCTGGGGAGTACTGGTGTGGGGTCGAAAAACGGGGCCCCGATGAGTCTTTA
CTGATCTCTCTGTTCGTCTTTCCAGGACCCTGCTGTCCTCCCTCCCCTTCTCCCACCTTCCAG
CCTCTGGCTACAACACGCCTGCAGCCCAAGGCAAAAGCTCAGCAAACCCAGCCCCCAGGATTG
ACTTCTCCTGGGCTCTACCCGGCAGCCACCACAGCCAAGCAGGGGAAGACAGGGGCTGAGGCC
CCTCCATTGCCAGGGACTTCCCAGTACGGGCACGAAAGGACTTCTCAGTACACAGGAACCTCT
CCTCACCCAGCGACCTCTCCTCCTGCAGGGAGCTCCCGCCCCCCATGCAGCTGGACTCCACC
TCAGCAGAGGACACCAGTCCAGCTCTCAGCAGTGGCAGCTCTAAGCCCAGGGTGTCCATCCCG
ATGGTCCGCATACTGGCCCCAGTCCTGGTGCTGCTGAGCCTTCTGTCAGCCGCAGGCCTGATC
GCCTTCTGCAGCCACCTGCTCCTGTGGAGAAAGGAAGCTCAACAGGCCACGGAGACACAGAGG
AACGAGAAGTTCTGGCTCTCACGCTTGACTGCGGAGGAAAAGGAAGCCCCTTCCCAGGCCCCT
GAGGGGGACGTGATCTCGATGCCTCCCCTCCACACATCTGAGGAGGAGCTGGGCTTCTCGAAG
TTTGTCTCAGCGTAGGGCAGGAGGCCCTCCTGGCCAGGCCAGCAGTGAAGCAGTATGGCTGGC
TGGATCAGCACCGATTCCCGAAAGCTTTCCACCTCAGCCTCAGAGTCCAGCTGCCGGACTCC
AGGGCTCTCCCCACCCTCCCCAGGCTCTCCTCTTGCATGTTCCAGCCTGACCTAGAAGCGTTT
GTCAGCCCTGGAGCCCAGAGCGGTGGCCTTGCTCTTCCGGCTGGAGACTGGGACATCCCTGAT
AGGTTCACATCCCTGGGCAGAGTACCAGGCTGCTGACCCTCAGCAGGGCCAGACAAGGCTCAG
TGGATCTGGTCTGAGTTTCAATCTGCCAGGAACTCCTGGGCCTCATGCCCAGTGTCGGACCCT
GCCTTCCTCCCACTCCAGACCCCACCTTGTCTTCCCTCCCTGGCGTCCTCAGACTTAGTCCCA
CGGTCTCCTGCATCAGCTGGTGATGAAGAGGAGCATGCTGGGGTGAGACTGGGATTCTGGCTT
CTCTTTGAACCACCTGCATCCAGCCCTTCAGGAAGCCTGTGAAAAACGTGATTCCTGGCCCCA
CCAAGACCCACCAAAACCATCTCTGGGCTTGGTGCAGGACTCTGAATTCTAACAATGCCCAGT
GACTGTCGCACTTGAGTTTGAGGGCCAGTGGGCCTGATGAACGCTCACACCCCTTCAGCTTAG
AGTCTGCATTTGGGCTGTGACGTCTCCACCTGCCCCAATAGATCTGCTCTGTCTGCGACACCA
GATCCACGTGGGGACTCCCCTGAGGCCTGCTAAGTCCAGGCCTTGGTCAGGTCAGGTGCACAT
TGCAGGATAAGCCCAGGACCGGCACAGAAGTGGTTGCCTTTNCCATTTGCCCTCCCTGGNCCA
TGCCTTCTTGCCTTTGAAAAAATGATGAAGAAAACCTTGGCTCCTTCCTTGTCTGGAAAGGG
TTACTTGCCTATGGGTTCTGGTGGCTAGAGAGAAAAGTAGAAAACCAGAGTGCACGTAGGTGT
CTAACACAGAGGAGAGTAGGAACAGGGCGGATACCTGAAGGTGACTCCGAGTCCAGCCCCTG
GAGAAGGGGTCGGGGGTGGTGGTAAAGTAGCACAACTACTATTTTTTTCTTTTTCCATTATT
ATTGTTTTTAAGACAGAATCTCGTGCTGCTGCCCAGGCTGGAGTGCAGTGGCACGATCTGCA
AACTCCGCCTCCTGGGTTCAAGTGATTCTTCTGCCTCAGCCTCCCGAGTAGCTGGGATTACAG
GCACGCACCACCACACCTGGCTAATTTTGTACTTTAGTAGAGATGGGGTTTCACCATGTTG
GCCAGGCTGGTCTTGAACTCCTGACCTCAAATGAGCCTCCTGCTTCAGTCTCCCAAATTGCCG
GGATTACAGGCATGAGCCACTGTGTCTGGCCCTATTTCCTTTAAAAAGTGAAATTAAGAGTTG
TTCAGTATGCAAAACTTGGAAAGATGGAGGAGAAAAAGAAAAGGAAGAAAAAAATGTCACCCA
TAGTCTCACCAGAGACTATCATTATTTCGTTTTGTTGTACTTCCTTCCACTCTTTTCTTCTTC
ACATAATTTGCCGGTGTTCTTTTTACAGAGCAATTATCTTGTATATACAACTTTGTATCCTGC
CTTTTCCACCTTATCGTTCCATCACTTTATTCCAGCACTTCTCTGTGTTTTACAGACCTTTTT
ATAAATAAATGTTCATCAGCTGCATAAAAAAAAAAAAAAA
```

FIGURE 386

MRLLVLLWGCLLLPGYEALEGPEEISGFEGDTVSLQCTYREELRDHRKYWCRKGGILFSRCSG
TIYAEEEGQETMKGRVSIRDSRQELSLIVTLWNLTLQDAGEYWCGVEKRGPDESLLISLFVFP
GPCCPPSPSPTFQPLATTRLQPKAKAQQTQPPGLTSPGLYPAATTAKQGKTGAEAPPLPGTSQ
YGHERTSQYTGTSPHPATSPPAGSSRPPMQLDSTSAEDTSPALSSGSSKPRVSIPMVRILAPV
LVLLSLLSAAGLIAFCSHLLLWRKEAQQATETQRNEKFWLSRLTAEEKEAPSQAPEGDVISMP
PLHTSEEELGFSKFVSA

Important features:
Signal peptide:
amino acids 1-17

Transmembrane domain:
amino acids 248-269

N-glycosylation site.
amino acids 96-99

Fibrinogen beta and gamma chains C-terminal domain.
amino acids 104-113

Ig like V-type domain:
amino acids 13-128

FIGURE 387

```
GCGCCGGGAGCCCATCTGCCCCCAGGGGCACGGGGCGCGGGGCCGGCTCCCGCCCGGCACATG
GCTGCAGCCACCTCGCGCGCACCCCGAGGCGCCGCGCCCAGCTCGCCCGAGGTCCGTCGGAGG
CGCCCGGCCGCCCCGGAGCCAAGCAGCAACTGAGCGGGGAAGCGCCCGCGTCCGGGGATCGGG
ATGTCCCTCCTCCTTCTCCTCTTGCTAGTTTCCTACTATGTTGGAACCTTGGGGACTCACACT
GAGATCAAGAGAGTGGCAGAGGAAAAGGTCACTTTGCCCTGCCACCATCAACTGGGGCTTCCA
GAAAAAGACACTCTGGATATTGAATGGCTGCTCACCGATAATGAAGGGAACCAAAAAGTGGTG
ATCACTTACTCCAGTCGTCATGTCTACAATAACTTGACTGAGGAACAGAAGGGCCGAGTGGCC
TTTGCTTCCAATTTCCTGGCAGGAGATGCCTCCTTGCAGATTGAACCTCTGAAGCCCAGTGAT
GAGGGCCGGTACACCTGTAAGGTTAAGAATTCAGGGCGCTACGTGTGGAGCCATGTCATCTTA
AAAGTCTTAGTGAGACCATCCAAGCCCAAGTGTGAGTTGGAAGGAGAGCTGACAGAAGGAAGT
GACCTGACTTTGCAGTGTGAGTCATCCTCTGGCACAGAGCCCATTGTGTATTACTGGCAGCGA
ATCCGAGAGAAAGAGGGAGAGGATGAACGTCTGCCTCCCAAATCTAGGATTGACTACAACCAC
CCTGGACGAGTTCTGCTGCAGAATCTTACCATGTCCTACTCTGGACTGTACCAGTGCACAGCA
GGCAACGAAGCTGGGAAGGAAAGCTGTGTGGTGCGAGTAACTGTACAGTATGTACAAAGCATC
GGCATGGTTGCAGGAGCAGTGACAGGCATAGTGGCTGGAGCCCTGCTGATTTTCCTCTTGGTG
TGGCTGCTAATCCGAAGGAAAGACAAAGAAAGATATGAGGAAGAAGAGAGACCTAATGAAATT
CGAGAAGATGCTGAAGCTCCAAAAGCCCGTCTTGTGAAACCCAGCTCCTCTTCCTCAGGCTCT
CGGAGCTCACGCTCTGGTTCTTCCTCCACTCGCTCCACAGCAAATAGTGCCTCACGCAGCCAG
CGGACACTGTCAACTGACGCAGCACCCCAGCCAGGGCTGGCCACCCAGGCATACAGCCTAGTG
GGGCCAGAGGTGAGAGGTTCTGAACCAAAGAAAGTCCACCATGCTAATCTGACCAAAGCAGAA
ACCACACCCAGCATGATCCCCAGCCAGAGCAGAGCCTTCCAAACGGTCTGAATTACAATGGAC
TTGACTCCCACGCTTTCCTAGGAGTCAGGGTCTTTGGACTCTTCTCGTCATTGGAGCTCAAGT
CACCAGCCACACAACCAGATGAGAGGTCATCTAAGTAGCAGTGAGCATTGCACGGAACAGATT
CAGATGAGCATTTTCCTTATACAATACCAAACAAGCAAAAGGATGTAAGCTGATTCATCTGTA
AAAAGGCATCTTATTGTGCCTTTAGACCAGAGTAAGGGAAAGCAGGAGTCCAAATCTATTTGT
TGACCAGGACCTGTGGTGAGAAGGTTGGGGAAAGGTGAGGTGAATATACCTAAAACTTTTAAT
GTGGGATATTTTGTATCAGTGCTTTGATTCACAATTTTCAAGAGGAAATGGGATGCTGTTTGT
AAATTTTCTATGCATTTCTGCAAACTTATTGGATTATTAGTTATTCAGACAGTCAAGCAGAAC
CCACAGCCTTATTACACCTGTCTACACCATGTACTGAGCTAACCACTTCTAAGAAACTCCAAA
AAAGGAAACATGTGTCTTCTATTCTGACTTAACTTCATTTGTCATAAGGTTTGGATATTAATT
TCAAGGGGAGTTGAAATAGTGGGAGATGGAGAAGAGTGAATGAGTTTCTCCCACTCTATACTA
ATCTCACTATTTGTATTGAGCCCAAAATAACTATGAAAGGAGACAAAAATTTGTGACAAAGGA
TTGTGAAGAGCTTTCCATCTTCATGATGTTATGAGGATTGTTGACAAACATTAGAAATATATA
ATGGAGCAATTGTGGATTTCCCCTCAAATCAGATGCCTCTAAGGACTTTCCTGCTAGATATTT
CTGGAAGGAGAAAATACAACATGTCATTTATCAACGTCCTTAGAAAGAATTCTTCTAGAGAAA
AAGGGATCTAGGAATGCTGAAAGATTACCCAACATACCATTATAGTCTCTTCTTTCTGAGAAA
ATGTGAAACCAGAATTGCAAGACTGGGTGGACTAGAAAGGGAGATTAGATCAGTTTTCTCTTA
ATATGTCAAGGAAGGTAGCCGGGCATGGTGCCAGGCACCTGTAGGAAAATCCAGCAGGTGGAG
GTTGCAGTGAGCCGAGATTATGCCATTGCACTCCAGCCTGGGTGACAGAGCGGGACTCCGTCTC
```

FIGURE 388

MSLLLLLLLLVSYYVGTLGTHTEIKRVAEEKVTLPCHHQLGLPEKDTLDIEWLLTDNEGNQKVV
ITYSSRHVYNNLTEEQKGRVAFASNFLAGDASLQIEPLKPSDEGRYTCKVKNSGRYVWSHVIL
KVLVRPSKPKCELEGELTEGSDLTLQCESSSGTEPIVYYWQRIREKEGEDERLPPKSRIDYNH
PGRVLLQNLTMSYSGLYQCTAGNEAGKESCVVRVTVQYVQSIGMVAGAVTGIVAGALLIFLLV
WLLIRRKDKERYEEEERPNEIREDAEAPKARLVKPSSSSSGSRSSRSGSSSTRSTANSASRSQ
RTLSTDAAPQPGLATQAYSLVGPEVRGSEPKKVHHANLTKAETTPSMIPSQSRAFQTV

Important freatures:

Signal sequence:

amino acids 1-16

Transmembrane domain:

amino acids 232-251

FIGURE 389

GCGGCACCTGGAAG<u>ATG</u>CGCCCATTGGCTGGTGGCCTGCTCAAGGTGGTGTTCGTGGTCTTCG
CCTCCTTGTGTGCCTGGTATTCGGGGTACCTGCTCGCAGAGCTCATTCCAGATGCACCCCTGT
CCAGTGCTGCCTATAGCATCCGCAGCATCGGGGAGAGGCCTGTCCTCAAAGCTCCAGTCCCCA
AAAGGCAAAAATGTGACCACTGGACTCCCTGCCCATCTGACACCTATGCCTACAGGTTACTCA
GCGGAGGTGGCAGAAGCAAGTACGCCAAAATCTGCTTTGAGGATAACCTACTTATGGGAGAAC
AGCTGGGAAATGTTGCCAGAGGAATAAACATTGCCATTGTCAACTATGTAACTGGGAATGTGA
CAGCAACACGATGTTTTGATATGTATGAAGGCGATAACTCTGGACCGATGACAAAGTTTATTC
AGAGTGCTGCTCCAAAATCCCTGCTCTTCATGGTGACCTATGACGACGGAAGCACAAGACTGA
ATAACGATGCCAAGAATGCCATAGAAGCACTTGGAAGTAAAGAAATCAGGAACATGAAATTCA
GGTCTAGCTGGGTATTTATTGCAGCAAAAGGCTTGGAACTCCCTTCCGAAATTCAGAGAGAAA
AGATCAACCACTCTGATGCTAAGAACAACAGATATTCTGGCTGGCCTGCAGAGATCCAGATAG
AAGGCTGCATACCCAAAGAACGAAGC<u>TGA</u>CACTGCAGGGTCCTGAGTAAATGTGTTCTGTATA
AACAAATGCAGCTGGAATCGCTCAAGAATCTTATTTTTCTAAATCCAACAGCCCATATTTGAT
GAGTATTTTGGGTTTGTTGTAAACCAATGAACATTTGCTAGTTGTATCAAATCTTGGTACGCA
GTATTTTTATACCAGTATTTTATGTAGTGAAGATGTCAATTAGCAGGAAACTAAAATGAATGG
AAATTCTTAAAAAAAAAA

FIGURE 390

MRPLAGGLLKVVFVVFASLCAWYSGYLLAELIPDAPLSSAAYSIRSIGERPVLKAPVPKRQKC
DHWTPCPSDTYAYRLLSGGGRSKYAKICFEDNLLMGEQLGNVARGINIAIVNYVTGNVTATRC
FDMYEGDNSGPMTKFIQSAAPKSLLFMVTYDDGSTRLNNDAKNAIEALGSKEIRNMKFRSSWV
FIAAKGLELPSEIQREKINHSDAKNNRYSGWPAEIQIEGCIPKERS

Important features:

Signal sequence.

amino acids 1-20

N-glycosylation sites.

amino acids 120-124, 208-212

Glycosaminoglycan attachment site.

amino acids 80-84

N-myristoylation sites.

amino acids 81-87, 108-114, 119-125

FIGURE 391

```
GGGGGCTTTCTTGGGCTTGGCTGCTTGGAACACCTGCCTCCAAGGACCGGCCTCGGAGGGGTCGCCGGGAAAGGG
AGGGAAGAAGGAAGGGCGGGGCCGGCCCCCCTGCGCCCGCCCCGCGCCTCTGCGCGCCCCTGTCCGCCCCGGCCC
AGCCCAGCCCAGCCCCGCGGGCCGGTCACACGCGCAGCCAGCCGGCCGCCTCCCGCGCCCAAGCGCGCGCTCTG
CTGTGCCCTGCGCCCTTGCCCCGCGCCAGCTTCTGCGCCCGCAGCCCGCCCGGCGCCCCCGGTGACCGTGACCCT
GCCCTGGGCGCGGGGCGGAGCAGGCATGTCCCGCCCGGGGACCGCTACCCCAGCGCTGGCCCTGGTGCTCCTGGC
AGTGACCCTGGCCGGGGTCGGAGCCCAGGGCGCAGCCCTCGAGGACCCTGATTATTACGGGCAGGAGATCTGGAG
CCGGGAGCCCTACTACGCGCGCCCGGAGCCCGAGCTCGAGACCTTCTCTCCGCCGCTGCCTGCGGGGCCCGGGGA
GGAGTGGGAGCGGCGCCCGCAGGAGCCCAGGCCGCCCAAGAGGGCCACCAAGCCCAAGAAAGCTCCCAAGAGGGA
GAAGTCGGCTCCGGAGCCGCCTCCACCAGGTAAACACAGCAACAAAAAAGTTATGAGAACCAAGAGCTCTGAGAA
GGCTGCCAACGATGATCACAGTGTCCGTGTGGCCCGTGAAGATGTCAGAGAGAGTTGCCCACCTCTTGGTCTGGA
AACCTTAAAAATCACAGACTTCCAGCTCCATGCCTCCACGGTGAAGCGCTATGGCCTGGGGGCACATCGAGGGAG
ACTCAACATCCAGGCGGGCATTAATGAAAATGATTTTTATGACGGAGCGTGGTGCGCGGGAAGAAATGACCTCCA
GCAGTGGATTGAAGTGGATGCTCGGCGCCTGACCAGATTCACTGGTGTCATCACTCAAGGGAGGAACTCCCTCTG
GCTGAGTGACTGGGTGACATCCTATAAGGTCATGGTGAGCAATGACAGCCACACGTGGGTCACTGTTAAGAATGG
ATCTGGAGACATGATATTTGAGGGAAACAGTGAGAAGGAGATCCCTGTTCTCAATGAGCTACCCGTCCCCATGGT
GGCCCGCTACATCCGCATAAACCCTCAGTCCTGGTTTGATAATGGGAGCATCTGCATGAGAATGGAGATCCTGGG
CTGCCCACTGCCAGATCCTAATAATTATTATCACCGCCGGAACGAGATGACCACCACTGATGACCTGGATTTTAA
GCACCACAATTATAAGGAAATGCGCCAGTTGATGAAAGTTGTGAATGAAATGTGTCCCAATATCACCAGAATTTA
CAACATTGGAAAAAGCCACCAGGGCCTGAAGCTGTATGCTGTGGAGATCTCAGATCACCCTGGGGAGCATGAAGT
CGGTGAGCCCGAGTTCCACTACATCGCGGGGCCCACGGCAATGAGGTGCTGGGCCGGGAGCTGCTGCTGCTGCT
GGTGCAGTTCGTGTGTCAGGAGTACTTGGCCCGGAATGCGCGCATCGTCCACCTGGTGGAGGAGACGCGGATTCA
CGTCCTCCCCTCCCTCAACCCCGATGGCTACGAGAAGGCCTACGAAGGGGGCTCGGAGCTGGGAGGCTGGTCCCT
GGGACGCTGGACCCACGATGGAATTGACATCAACAACAACTTTCCTGATTTAAACACGCTGCTCTGGGAGGCAGA
GGATCGACAGAATGTCCCCAGGAAAGTTCCCAATCACTATATTGCAATCCCTGAGTGGTTTCTGTCGGAAAATGC
CACGGTGGCTGCCGAGACCAGAGCAGTCATAGCCTGGATGGAAAAAATCCCTTTTGTGCTGGGCGGCAACCTGCA
GGGCGGCGAGCTGGTGGTGGCGTATCCCTACGACCTGGTGCGGTCCCCCTGGAAGACGCAGGAACACACCCCCAC
CCCCGATGACCACGTGTTCCGCTGGCTGGCCTACTCCTATGCCTCCACACACCGCCTCATGACAGACGCCCGGAG
GAGGGTGTGCCACACGGAGGACTTCCAGAAGGAGGAGGGCACTGTCAATGGGGCCTCCTGGCACACCGTCGCTGG
AAGTCTGAACGATTTCAGCTACCTTCATACAAACTGCTTCGAACTGTCCATCTACGTGGGCTGTGATAAATACCC
ACATGAGAGCCAGCTGCCCGAGGAGTGGGAGAATAACCGGGAATCTCTGATCGTGTTCATGGAGCAGGTTCATCG
TGGCATTAAAGGCTTGGTGAGAGATTCACATGGAAAAGGAATCCCAAACGCCATTATCTCCGTAGAAGGCATTAA
CCATGACATCCGAACAGCCAACGATGGGGATTACTGGCGCCTCCTGAACCCTGGAGAGTATGTGGTCACAGCAAA
GGCCGAAGGTTTCACTGCATCCACCAAGAACTGTATGGTTGGCTATGACATGGGGGCCACAAGGTGTGACTTCAC
ACTTAGCAAAACCAACATGGCCAGGATCCGAGAGATCATGGAGAAGTTTGGGAAGCAGCCCGTCAGCCTGCCAGC
CAGGCGGCTGAAGCTGCGGGGGCGGAAGAGACGACAGCGTGGGTGACCCTCCTGGGCCCTTGAGACTCGTCTGGG
ACCCATGCAAATTAAACCAACCTGGTAGTAGCTCCATAGTGGACTCACTCACTGTTGTTTCCTCTGTAATTCAAG
AAGTGCCTGGAAGAGAGGGTGCATTGTGAGGCAGGTCCCAAAAGGGAAGGCTGGAGGCTGAGGCTGTTTTCTTTT
CTTTGTTCCCATTTATCCAAATAACTTGGACAGAGCAGCAGAGAAAAGCTGATGGGAGTGAGAGAACTCAGCAAG
CCAACCTGGGAATCAGAGAGAAGGAAGGAAGGAGGGGAGCCTGTCCGTTCAGAGCCTCTGGCTGCATAGAAAAGG
ATTCTGGTGCTTCCCCTGTTTGCGTGGCAGCAAGGGTTCCACGTGCATTTGCAATTTGCACAGCTAAAATTGCAG
CATTTCCCCAGCTGGGCTGTCCCAAATGTTACCATTTGAGATGCTCCCAGGCGTCCTAAGAGAATCCACCCTCTC
TGGCCCTGGGACATTGCAAGCTGCTACAAATAAATTCTGTGTTCTTTTGACAATAGCGTCATTGCCAAGTGCACA
TCAGTGAGCCTCTTGAATCTGTTTAGTCTCCTTTTTTCAACAAAGGAGTGTGTTCAGAAAAGGAGAGAGAGGCTGA
GATCATTCAGGAGTTTGTTGGGCAGCAAGCATGGAGCTTCTTGCACAAATTCTGGGTCCATAAACAACCCCCAAA
GTCCCTGCTGATCCAGTAGCCCTGGAGGTTCCCCAGGTAGGGAGAGCCAGAGGTGCCAGCCTTCCTGAAGGGCCA
GAAAATTTAGCCTGGATCTCCTCTTTTACCTGCTAGGACTGGAAAGAGCCAGAAGTGGGGTGGCCTGAAGCCCTC
TCTCTGCTTGAGGTATTGCCCCTGTGTGGAATTGAGTGCTCATGGGTTGGCCTCATATCAGCCTGGGAGTTATTT
TTGATATGTAGAATGCCAGATCTTCCAGATTAGGCTAAATGTAATGAAAACCTCTTAGGATTATCTGTGGAGCAT
CAGTTTGGGAAGAATTATTGAATTATCTTGCAAGAAAAAGTATGTCTCACTTTTTGTTAATGTTGCTGCCTCAT
TGACCTGGGAAAAATGAAAAAAAAAAATAAAGCAAATGGTAAGACCCTTAAAAAAAAAAAAAAAAAAAAAAAAAA
AAAAAAAAAAAAAAAAAAAAA
```

FIGURE 392

MSRPGTATPALALVLLAVTLAGVGAQGAALEDPDYYGQEIWSREPYYARPEPELETFSPPLPA
GPGEEWERRPQEPRPPKRATKPKKAPKREKSAPEPPPPGKHSNKKVMRTKSSEKAANDDHSVR
VAREDVRESCPPLGLETLKITDFQLHASTVKRYGLGAHRGRLNIQAGINENDFYDGAWCAGRN
DLQQWIEVDARRLTRFTGVITQGRNSLWLSDWVTSYKVMVSNDSHTWVTVKNGSGDMIFEGNS
EKEIPVLNELPVPMVARYIRINPQSWFDNGSICMRMEILGCPLPDPNNYYHRRNEMTTTDDLD
FKHHNYKEMRQLMKVVNEMCPNITRIYNIGKSHQGLKLYAVEISDHPGEHEVGEPEFHYIAGA
HGNEVLGRELLLLLVQFVCQEYLARNARIVHLVEETRIHVLPSLNPDGYEKAYEGGSELGGWS
LGRWTHDGIDINNNFPDLNTLLWEAEDRQNVPRKVPNHYIAIPEWFLSENATVAAETRAVIAW
MEKIPFVLGGNLQGGELVVAYPYDLVRSPWKTQEHTPTPDDHVFRWLAYSYASTHRLMTDARR
RVCHTEDFQKEEGTVNGASWHTVAGSLNDFSYLHTNCFELSIYVGCDKYPHESQLPEEWENNR
ESLIVFMEQVHRGIKGLVRDSHGKGIPNAIISVEGINHDIRTANDGDYWRLLNPGEYVVTAKA
EGFTASTKNCMVGYDMGATRCDFTLSKTNMARIREIMEKFGKQPVSLPARRLKLRGRKRRQRG

FIGURE 393

```
GTCCCACATCCTGCTCAACTGGGTCAGGTCCCTCTTAGACCAGCTCTTGTCCATCATTTGCTGAAGTGGACCAAC
TAGTTCCCCAGTAGGGGGTCTCCCCTGGCAATTCTTGATCGGCGTTTGGACATCTCAGATCGCTTCCAATGAAGA
TGGCCTTGCCTTGGGGTCCTGCTTGTTTCATAATCATCTAACTATGGGACAAGGTTGTGCCGGCAGCTCTGGGGG
AAGGAGCACGGGGCTGATCAAGCCATCCAGGAAACACTGGAGGACTTGTCCAGCCTTGAAAGAACTCTAGTGGTT
TCTGAATCTAGCCCACTTGGCGGTAAGCATGATGCAACTTCTGCAACTTCTGCTGGGGCTTTTGGGGCCAGGTGG
CTACTTATTTCTTTTAGGGGATTGTCAGGAGGTGACCACTCTCACGGTGAAATACCAAGTGTCAGAGGAAGTGCC
ATCTGGTACAGTGATCGGGAAGCTGTCCCAGGAACTGGGCCGGGAGGAGAGGCGGAGGCAAGCTGGGGCCGCCTT
CCAGGTGTTGCAGCTGCCTCAGGCGCTCCCCATTCAGGTGGACTCTGAGGAAGGCTTGCTCAGCACAGGCAGGCG
GCTGGATCGAGAGCAGCTGTGCCGACAGTGGATCCCTGCCTGGTTTCCTTTGATGTGCTTGCCACAGGGGATTT
GGCTCTGATCCATGTGGAGATCCAAGTGCTGGACATCAATGACCACCAGCCACGGTTTCCCAAAGGCGAGCAGGA
GCTGGAAATCTCTGAGAGCGCCTCTCTGCGAACCCGGATCCCCCTGGACAGAGCTCTTGACCCAGACACAGGCCC
TAACACCCTGCACACCTACACTCTGTCTCCCAGTGAGCACTTTGCCTTGGATGTCATTGTGGGCCCTGATGAGAC
CAAACATGCAGAACTCATAGTGGTGAAGGAGCTGGACAGGGAAATCCATTCATTTTTTGATCTGGTGTTAACTGC
CTATGACAATGGGAACCCCCCAAGTCAGGTACCAGCTTGGTCAAGGTCAACGTCTTGGACTCCAATGACAATAG
CCCTGCGTTTGCTGAGAGTTCACTGGCACTGGAAATCCAAGAAGATGCTGCACCTGGTACGCTTCTCATAAAACT
GACCGCCACAGACCCTGACCAAGGCCCCAATGGGGAGGTGGAGTTCTTCCTCAGTAAGCACATGCCTCCAGAGGT
GCTGGACACCTTCAGTATTGATGCCAAGACAGGCCAGGTCATTCTGCGTCGACCTCTAGACTATGAAAAGAACCC
TGCCTACGAGGTGGATGTTCAGGCAAGGGACCTGGGTCCCAATCCTATCCCAGCCCATTGCAAAGTTCTCATCAA
GGTTCTGGATGTCAATGACAACATCCCAAGCATCCACGTCACATGGGCCTCCCAGCCATCACTGGTGTCAGAAGC
TCTTCCCAAGGACAGTTTTATTGCTCTTGTCATGGCAGATGACTTGGATTCAGGACACAATGGTTTGGTCCACTG
CTGGCTGAGCCAAGAGCTGGGCCACTTCAGGCTGAAAAGAACTAATGGCAACACATACATGTTGTAACCAATGC
CACACTGGACAGAGAGCAGTGGCCCAAATATACCCTCACTCTGTTAGCCCAAGACCAAGGACTCCAGCCCTTATC
AGCCAAGAAACAGCTCAGCATTCAGATCAGTGACATCAACGACAATGCACCTGTGTTTGAGAAAAGCAGGTATGA
AGTCTCCACGCGGGAAAACAACTTACCCTCTCTTCACCTCATTACCATCAAGGCTCATGATGCAGACTTGGGCAT
TAATGGAAAAGTCTCATACCGCATCCAGGACTCCCCAGTTGCTCACTTAGTAGCTATTGACTCCAACACAGGAGA
GGTCACTGCTCAGAGGTCACTGAACTATGAAGAGATGGCCGGCTTTGAGTTCCAGGTGATCGCAGAGGACAGCGG
GCAACCCATGCTTGCATCCAGTGTCTCTGTGTGGGTCAGCCTCTTGGATGCCAATGATAATGCCCCAGAGGTGGT
CCAGCCTGTGCTCAGCGATGGAAAAGCCAGCCTCTCCGTGCTTGTGAATGCCTCCACAGGCCACCTGCTGGTGCC
CATCGAGACTCCCAATGGCTTGGGCCCAGCGGGCACTGACACACCTCCACTGGCCACTCACAGCTCCCGGCCATT
CCTTTTGACAACCATTGTGCCAAGAGATCGAGACTCGGGGGCAAATGGAGAGCCCCTCTACAGCATCCGCAATGG
AAATGAAGCCCACCTCTTCATCCTCAACCCTCATACGGGGCAGCTGTTCGTCAATGTCACCAATGCCAGCAGCCT
CATTGGGAGTGAGTGGGAGCTGGAGATAGTAGTAGAGGACCAGGGAAGCCCCCCCTTACAGACCCGAGCCCTGTT
GAGGGTCATGTTTGTCACCAGTGTGGACCACCTGAGGGACTCAGCCCGCAAGCCTGGGGCCTTGAGCATGTCGAT
GCTGACGGTGATCTGCCTGGCTGTACTGTTGGGCATCTTCGGGTTGATCCTGGCTTTGTTCATGTCCATCTGCCG
GACAGAAAAGAAGGACAACAGGGCCTACAACTGTCGGGAGGCCGAGTCCACCTACCGCCAGCAGCCCAAGAGGCC
CCAGAAACACATTCAGAAGGCAGACATCCACCTCGTGCCTGTGCTCAGGGGTCAGGCAGGTGAGCCTTGTGAAGT
CGGGCAGTCCCACAAAGATGTGGACAAGGAGGCGATGATGGAAGCAGGCTGGGACCCCTGCCTGCAGGCCCCCTT
CCACCTCACCCCGACCCTGTACAGGACGCTGCGTAATCAAGGCAACCAGGGAGCACCGGCGGAGAGCCGAGAGGT
GCTGCAAGACACGGTCAACCTCCTTTTCAACCATCCAGGCAGGGAATGCCTCCCGGGAGAACCTGAACCTTCC
CGAGCCCCAGCCTGCCACAGGCCAGCCACGTTCCAGGCCTCTGAAGGTTGCAGGCAGCCCCACAGGGAGGCTGGC
TGGAGACCAGGGCAGTGAGGAAGCCCCACAGAGGCCACCAGCCTCCTCTGCAACCCTGAGACGGCAGCGACATCT
CAATGGCAAAGTGTCCCCTGAGAAAGAATCAGGGCCCCGTCAGATCCTGCGGAGCCTGGTCCGGCTGTCTGTGGC
TGCCTTCGCCGAGCGGAACCCCGTGGAGGAGCTCACTGTGGATTCTCCTCCTGTTCAGCAAATCTCCCAGCTGCT
GTCCTTGCTGCATCAGGGCCAATTCCAGCCCAAACCAAACCACCGAGGAAATAAGTACTTGGCCAAGCCAGGAGG
CAGCAGGAGTGCAATCCCAGACACAGATGGCCCAAGTGCAAGGGCTGGAGGCAGACAGACCCAGAACAGGAGGA
AGGGCCTTTGGATCCTGAAGAGGACCTCTCTGTGAAGCAACTGCTAGAAGAAGAGCTGTCAAGTCTGCTGGACCC
CAGCACAGGTCTGGCCCTGGACCGGCTGAGCGCCCTGACCCGGCCTGGATGGCGAGACTCTCTTTGCCCCTCAC
CACCAACTACCGTGACAATGTGATCTCCCCGGATGCTGCAGCCACGGAGGAGCCGAGGACCTTCCAGACGTTCGG
CAAGGCAGAGGCACCAGAGCTGAGCCCAACAGGCAGCTGGCCAGCACCTTTGTCTCGGAGATGAGCTCACT
GCTGGAGATGCTGGAACAGCGCTCCAGCATGCCCGTGGAGGCCGCCTCCGAGGCGCTGCGGCGGCTCTCGGT
CTGCGGGAGGACCCTCAGTTTAGACTTGGCCACCAGTGCAGCCTCAGGCATGAAAGTGCAAGGGGACCCAGGTGG
AAAGACGGGGACTGAGGGCAAGAGCAGAGGCAGCAGCAGCAGCAGCAGGTGCCTGTGAACATACCTCAGACGCCT
CTGGATCCAAGAACCAGGGGCCTGAGGATCTGTGGACAAGAGCTGGTTTCTAAAATCTTGTAACTCACTAGCTAG
CGGCGGCCTGAGAACTTTAGGGTGACTGATGCTACCCCCACAGAGGAGGCAAGAGCCCCAGGACTAACAGCTGAC
TGACCAAAGCAGCCCCTTGTAAGCAGCTCTGAGTCTTTTGGAGGACAGGGACGGTTTGTGGCTGAGATAAGTGTT
TCCTGGCAAAACATATGTGGAGCACAAAGGGTCAGTCCTCTGGCAGAACAGATGCCACGGAGTATCACAGGCAGG
AAAGGGTGGCCTTCTTGGGTAGCAGGAGTCAGGGGCTGTACCCTGGGGGTGCCAGGAAATGCTCTCTGACCTAT
CAATAAAGGAAAGCAGTAAAAAAAAAAAAAAAAAAAAAA
```

FIGURE 394

MMQLLQLLLGLLGPGGYLFLLGDCQEVTTLTVKYQVSEEVPSGTVIGKLSQELGREERRRQAG
AAFQVLQLPQALPIQVDSEEGLLSTGRRLDREQLCRQWDPCLVSFDVLATGDLALIHVEIQVL
DINDHQPRFPKGEQELEISESASLRTRIPLDRALDPDTGPNTLHTYTLSPSEHFALDVIVGPD
ETKHAELIVVKELDREIHSFFDLVLTAYDNGNPPKSGTSLVKVNVLDSNDNSPAFAESSLALE
IQEDAAPGTLLIKLTATDPDQGPNGEVEFFLSKHMPPEVLDTFSIDAKTGQVILRRPLDYEKN
PAYEVDVQARDLGPNPIPAHCKVLIKVLDVNDNIPSIHVTWASQPSLVSEALPKDSFIALVMA
DDLDSGHNGLVHCWLSQELGHFRLKRTNGNTYMLLTNATLDREQWPKYTLTLLAQDQGLQPLS
AKKQLSIQISDINDNAPVFEKSRYEVSTRENNLPSLHLITIKAHDADLGINGKVSYRIQDSPV
AHLVAIDSNTGEVTAQRSLNYEEMAGFEFQVIAEDSGQPMLASSVSVWVSLLDANDNAPEVVQ
PVLSDGKASLSVLVNASTGHLLVPIETPNGLGPAGTDTPPLATHSSRPFLLTTIVARDADSGA
NGEPLYSIRNGNEAHLFILNPHTGQLFVNVTNASSLIGSEWELEIVVEDQGSPPLQTRALLRV
MFVTSVDHLRDSARKPGALSMSMLTVICLAVLLGIFGLILALFMSICRTEKKDNRAYNCREAE
STYRQQPKRPQKHIQKADIHLVPVLRGQAGEPCEVGQSHKDVDKEAMMEAGWDPCLQAPFHLT
PTLYRTLRNQGNQGAPAESREVLQDTVNLLFNHPRQRNASRENLNLPEPQPATGQPRSRPLKV
AGSPTGRLAGDQGSEEAPQRPPASSATLRRQRHLNGKVSPEKESGPRQILRSLVRLSVAAFAE
RNPVEELTVDSPPVQQISQLLSLLHQGQFQPKPNHRGNKYLAKPGGSRSAIPDTGPSARAGG
QTDPEQEEGPLDPEEDLSVKQLLEEELSSLLDPSTGLALDRLSAPDPAWMARLSLPLTTNYRD
NVISPDAAATEEPRTFQTFGKAEAPELSPTGTRLASTFVSEMSSLLEMLLEQRSSMPVEAASE
ALRRLSVCGRTLSLDLATSAASGMKVQGDPGGKTGTEGKSRGSSSSSRCL

Important features:
Signal peptide:
amino acids 1-13
Transmembrane domain:
amino acids 719-739
N-glycosylation site.
amino acids 415-418, 582-585, 659-662, 662-665 amd 857-860
Cadherins extracellular repeated domain signature.
amino acids 123-133, 232-242, 340-350, 448-458 and 553-563

FIGURE 395

```
CCCAGGCTCTAGTGCAGGAGGAGAAGGAGGAGGAGCAGGAGGTGGAGATTCCCAGTTAAAAGG
CTCCAGAATCGTGTACCAGGCAGAGAACTGAAGTACTGGGGCCTCCTCCACTGGGTCCGAATC
AGTAGGTGACCCCGCCCCTGGATTCTGGAAGACCTCACCATGGGACGCCCCGACCTCGTGCG
GCCAAGACGTGGATGTTCCTGCTCTTGCTGGGGGGAGCCTGGGCAGGACACTCCAGGGCACAG
GAGGACAAGGTGCTGGGGGGTCATGAGTGCCAACCCCATTCGCAGCCTTGGCAGGCGGCCTTG
TTCCAGGGCCAGCAACTACTCTGTGGCGGTGTCCTTGTAGGTGGCAACTGGGTCCTTACAGCT
GCCCACTGTAAAAAACCGAAATACACAGTACGCCTGGGAGACCACAGCCTACAGAATAAAGAT
GGCCCAGAGCAAGAAATACCTGTGGTTCAGTCCATCCCACACCCCTGCTACAACAGCAGCGAT
GTGGAGGACCACAACCATGATCTGATGCTTCTTCAACTGCGTGACCAGGCATCCCTGGGGTCC
AAAGTGAAGCCCATCAGCCTGGCAGATCATTGCACCCAGCCTGGCCAGAAGTGCACCGTCTCA
GGCTGGGGCACTGTCACCAGTCCCCGAGAGAATTTTCCTGACACTCTCAACTGTGCAGAAGTA
AAAATCTTTCCCCAGAAGAAGTGTGAGGATGCTTACCCGGGGCAGATCACAGATGGCATGGTC
TGTGCAGGCAGCAGCAAAGGGGCTGACACGTGCCAGGGCGATTCTGGAGGCCCCCTGGTGTGT
GATGGTGCACTCCAGGGCATCACATCCTGGGGCTCAGACCCCTGTGGGAGGTCCGACAAACCT
GGCGTCTATACCAACATCTGCCGCTACCTGGACTGGATCAAGAAGATCATAGGCAGCAAGGGC
TGATTCTAGGATAAGCACTAGATCTCCCTTAATAAACTCACAACTCTCTGGTTC
```

FIGURE 396

MGRPRPRAAKTWMFLLLLGGAWAGHSRAQEDKVLGGHECQPHSQPWQAALFQGQQLLCGGVLV
GGNWVLTAAHCKKPKYTVRLGDHSLQNKDGPEQEIPVVQSIPHPCYNSSDVEDHNHDLMLLQL
RDQASLGSKVKPISLADHCTQPGQKCTVSGWGTVTSPRENFPDTLNCAEVKIFPQKKCEDAYP
GQITDGMVCAGSSKGADTCQGDSGGPLVCDGALQGITSWGSDPCGRSDKPGVYTNICRYLDWI
KKIIGSKG

Important Features:
Signal peptide:
amino acids 1-23

Transmembrane domain:
amino acids 51-71

N-glycosylation site.
amino acids 110-113

Serine proteases, trypsin family, histidine active site.
amino acids 69-74 and 207-217

Tyrosine kinase phosphorylation site.
amino acids 182-188

Kringle domain proteins motif
amino acids 205-217

FIGURE 397

GGCGGCTGCTGAGCTGCCTTGAGGTGCAGTGTTGGGGATCCAGAGCCATGTCGGACCTGCTAC
TACTGGGCCTGATTGGGGGCCTGACTCTCTTACTGCTGCTGACGCTGCTGGCCTTTGCCGGGT
ACTCAGGGCTACTGGCTGGGGTGGAAGTGAGTGCTGGGTCACCCCCCATCCGCAACGTCACTG
TGGCCTACAAGTTCCACATGGGGCTCTATGGTGAGACTGGGCGGCTTTTCACTGAGAGCTGCA
GCATCTCTCCCAAGCTCCGCTCCATCGCTGTCTACTATGACAACCCCCACATGGTGCCCCCTG
ATAAGTGCCGATGTGCCGTGGGCAGCATCCTGAGTGAAGGTGAGGAATCGCCCTCCCCTGAGC
TCATCGACCTCTACCAGAAATTTGGCTTCAAGGTGTTCTCCTTCCCGGCACCCAGCCATGTGG
TGACAGCCACCTTCCCCTACACCACCATTCTGTCCATCTGGCTGGCTACCCGCCGTGTCCATC
CTGCCTTGGACACCTACATCAAGGAGCGGAAGCTGTGTGCCTATCCTCGGCTGGAGATCTACC
AGGAAGACCAGATCCATTTCATGTGCCCACTGGCACGGCAGGGAGACTTCTATGTGCCTGAGA
TGAAGGAGACAGAGTGGAAATGGCGGGGCTTGTGGAGGCCATTGACACCCAGGTGGATGGCA
CAGGAGCTGACACAATGAGTGACACGAGTTCTGTAAGCTTGGAAGTGAGCCCTGGCAGCCGGG
AGACTTCAGCTGCCACACTGTCACCTGGGGCGAGCAGCCGTGGCTGGGATGACGGTGACACCC
GCAGCGAGCACAGCTACAGCGAGTCAGGTGCCAGCGGCTCCTCTTTTGAGGAGCTGGACTTGG
AGGGCGAGGGGCCCTTAGGGGAGTCACGGCTGGACCCTGGGACTGAGCCCCTGGGGACTACCA
AGTGGCTCTGGGAGCCCACTGCCCCTGAGAAGGGCAAGGAGTAACCCATGGCCTGCACCCTCC
TGCAGTGCAGTTGCTGAGGAACTGAGCAGACTCTCCAGCAGACTCTCCAGCCCTCTTCCTCCT
TCCTCTGGGGGAGGAGGGGTTCCTGAGGGACCTGACTTCCCCTGCTCCAGGCCTCTTGCTAAG
CCTTCTCCTCACTGCCCTTTAGGCTCCCAGGGCCAGAGGAGCCAGGGACTATTTTCTGCACCA
GCCCCCAGGGCTGCCGCCCCTGTTGTGTCTTTTTTTCAGACTCACAGTGGAGCTTCCAGGACC
CAGAATAAAGCCAATGATTTACTTGTTTCACCTGGAAAAAAAAAAAAAAAAA

FIGURE 398

MSDLLLLGLIGGLTLLLLLTLLAFAGYSGLLAGVEVSAGSPPIRNVTVAYKFHMGLYGETGRL
FTESCSISPKLRSIAVYYDNPHMVPPDKCRCAVGSILSEGEESPSPELIDLYQKFGFKVFSFP
APSHVVTATFPYTTILSIWLATRRVHPALDTYIKERKLCAYPRLEIYQEDQIHFMCPLARQGD
FYVPEMKETEWKWRGLVEAIDTQVDGTGADTMSDTSSVSLEVSPGSRETSAATLSPGASSRGW
DDGDTRSEHSYSESGASGSSFEELDLEGEGPLGESRLDPGTEPLGTTKWLWEPTAPEKGKE

FIGURE 399

GGACGAGGGCAGATCTCGTTCTGGGGCAAGCCGTTGACACTCGCTCCCTGCCACCGCCCGGGC
TCCGTGCCGCCAAGTTTTCATTTTCCACCTTCTCTGCCTCCAGTCCCCCAGCCCTGGCCGAG
AGAAGGGTCTTACCGGCCGGGATTGCTGGAAACACCAAGAGGTGGTTTTTGTTTTTTAAAACT
TCTGTTTCTTGGGAGGGGGTGTGGCGGGGCAGG<ins>ATG</ins>AGCAACTCCGTTCCTCTGCTCTGTTTC
TGGAGCCTCTGCTATTGCTTTGCTGCGGGGAGCCCCGTACCTTTTGGTCCAGAGGGACGGCTG
GAAGATAAGCTCCACAAACCCAAAGCTACACAGACTGAGGTCAAACCATCTGTGAGGTTTAAC
CTCCGCACCTCCAAGGACCCAGAGCATGAAGGATGCTACCTCTCCGTCGGCCACAGCCAGCCC
TTAGAAGACTGCAGTTTCAACATGACAGCTAAAACCTTTTTCATCATTCACGGATGGACGATG
AGCGGTATCTTTGAAAACTGGCTGCACAAACTCGTGTCAGCCCTGCACACAAGAGAGAAAGAC
GCCAATGTAGTTGTGGTTGACTGGCTCCCCCTGGCCCACCAGCTTTACACGGATGCGGTCAAT
AATACCAGGGTGGTGGGACACAGCATTGCCAGGATGCTCGACTGGCTGCAGGAGAAGGACGAT
TTTTCTCTCGGGAATGTCCACTTGATCGGCTACAGCCTCGGAGCGCACGTGGCCGGGTATGCA
GGCAACTTCGTGAAAGGAACGGTGGGCCGAATCACAGGTTTGGATCCTGCCGGGCCCATGTTT
GAAGGGGCCGACATCCACAAGAGGCTCTCTCCGGACGATGCAGATTTTGTGGATGTCCTCCAC
ACCTACACGCGTTCCTTCGGCTTGAGCATTGGTATTCAGATGCCTGTGGGCCACATTGACATC
TACCCCAATGGGGGTGACTTCCAGCCAGGCTGTGGACTCAACGATGTCTTGGGATCAATTGCA
TATGGAACAATCACAGAGGTGGTAAAATGTGAGCATGAGCGAGCCGTCCACCTCTTTGTTGAC
TCTCTGGTGAATCAGGACAAGCCGAGTTTTGCCTTCCAGTGCACTGACTCCAATCGCTTCAAA
AAGGGGATCTGTCTGAGCTGCCGCAAGAACCGTTGTAATAGCATTGGCTACAATGCCAAGAAA
ATGAGGAACAAGAGGAACAGCAAAATGTACCTAAAAACCCGGGCAGGCATGCCTTTCAGAGGT
AACCTTCAGTCCCTGGAGTGTCCC<ins>TGA</ins>GGAAGGCCCTTAATACCTCCTTCTTAATACCATGCT
GCAGAGCAGGGCACATCCTAGCCCAGGAGAAGTGGCCAGCACAATCCAATCAAATCGTTGCAA
ATCAGATTACACTGTGCATGTCCTAGGAAAGGGAATCTTTACAAAATAAACAGTGTGGACCCC
TAATAAAAAAAAAAAAAAAAAAAAAAAAAAAAAAAAAAAAAAAAAAAAAAAAAAAAAAAAAAA

FIGURE 400

MSNSVPLLCFWSLCYCFAAGSPVPFGPEGRLEDKLHKPKATQTEVKPSVRFNLRTSKDPEHEG
CYLSVGHSQPLEDCSFNMTAKTFFIIHGWTMSGIFENWLHKLVSALHTREKDANVVVVDWLPL
AHQLYTDAVNNTRVVGHSIARMLDWLQEKDDFSLGNVHLIGYSLGAHVAGYAGNFVKGTVGRI
TGLDPAGPMFEGADIHKRLSPDDADFVDVLHTYTRSFGLSIGIQMPVGHIDIYPNGGDFQPGC
GLNDVLGSIAYGTITEVVKCEHERAVHLFVDSLVNQDKPSFAFQCTDSNRFKKGICLSCRKNR
CNSIGYNAKKMRNKRNSKMYLKTRAGMPFRGNLQSLECP

Important features:
Signal peptide:
amino acids 1-16

Lipases, serine active site.
amino acids 163-172

N-glycosylation sites.
amino acids 80-83 and 136-139

FIGURE 401

CTTCCCAGCCCTGTGCCCCAAAGCACCTGGAGCATATAGCCTTGCAGAACTTCTACTTGCCTG
CCTCCCTGCCTCTGGCCATGGCCTGCCGGTGCCTCAGCTTCCTTCTGATGGGGACCTTCCTGT
CAGTTTCCCAGACAGTCCTGGCCCAGCTGGATGCACTGCTGGTCTTCCCAGGCCAAGTGGCTC
AACTCTCCTGCACGCTCAGCCCCAGCACGTCACCATCAGGGACTACGGTGTGTCCTGGTACC
AGCAGCGGGCAGGCAGTGCCCCTCGATATCTCCTCTACTACCGCTCGGAGGAGGATCACCACC
GGCCTGCTGACATCCCCGATCGATTCTCGGCAGCCAAGGATGAGGCCCACAATGCCTGTGTCC
TCACCATTAGTCCCGTGCAGCCTGAAGACGACGCGGATTACTACTGCTCTGTTGGCTACGGCT
TTAGTCCCTAGGGGTGGGGTGTGAGATGGGTGCCTCCCCTCTGCCTCCCATTTCTGCCCCTGA
CCTTGGGTCCCTTTTAAACTTTCTCTGAGCCTTGCTTCCCCTCTGTAAAATGGGTTAATAATA
TTCAACATGTCAACAAC

FIGURE 402

MACRCLSFLLMGTFLSVSQTVLAQLDALLVFPGQVAQLSCTLSPQHVTIRDYGVSWYQQRAGS
APRYLLYYRSEEDHHRPADIPDRFSAAKDEAHNACVLTISPVQPEDDADYYCSVGYGFSP

FIGURE 403

```
CGCGCCGGGCGCAGGGAGCTGAGTGGACGGCTCGAGACGGCGGCGCGTGCAGCAGCTCCAGAAAGCAGCGAGTTG
GCAGAGCAGGGCTGCATTTCCAGCAGGAGCTGCGAGCACAGTGCTGGCTCACAACAAGATGCTCAAGGTGTCAGC
CGTACTGTGTGTGTGTGCAGCCGCTTGGTGCAGTCAGTCTCTCGCAGCTGCCGCGGCGGTGGCTGCAGCCGGGGG
GCGGTCGGACGGCGGTAATTTTCTGGATGATAAACAATGGCTCACCACAATCTCTCAGTATGACAAGGAAGTCGG
ACAGTGGAACAAATTCCGAGACGAAGTAGAGGATGATTATTTCCGCACTTGGAGTCCAGGAAAACCCTTCGATCA
GGCTTTAGATCCAGCTAAGGATCCATGCTTAAAGATGAAATGTAGTCGCCATAAAGTATGCATTGCTCAAGATTC
TCAGACTGCAGTCTGCATTAGTCACCGGAGGCTTACACACAGGATGAAAGAAGCAGGAGTAGACCATAGGCAGTG
GAGGGGTCCCATATTATCCACCTGCAAGCAGTGCCCAGTGGTCTATCCCAGCCCTGTTTGTGGTTCAGATGGTCA
TACCTACTCTTTTCAGTGCAAACTAGAATATCAGGCATGTGTCTTAGGAAAACAGATCTCAGTCAAATGTGAAGG
ACATTGCCCATGTCCTTCAGATAAGCCCACCAGTACAAGCAGAAATGTTAAGAGAGCATGCAGTGACCTGGAGTT
CAGGGAAGTGGCAAACAGATTGCGGGACTGGTTCAAGGCCCTTCATGAAAGTGGAAGTCAAAACAAGAAGACAAA
AACATTGCTGAGGCCTGAGAGAAGCAGATTCGATACCAGCATCTTGCCAATTTGCAAGGACTCACTTGGCTGGAT
GTTTAACAGACTTGATACAAACTATGACCTGCTATTGGACCAGTCAGAGCTCAGAAGCATTTACCTTGATAAGAA
TGAACAGTGTACCAAGGCATTCTTCAATTCTTGTGACACATACAAGGACAGTTTAATATCTAATAATGAGTGGTG
CTACTGCTTCCAGAGACAGCAAGACCCACCTTGCCAGACTGAGCTCAGCAATATTCAGAAGCGGCAAGGGGTAAA
GAAGCTCCTAGGACAGTATATCCCCCTGTGTGATGAAGATGGTTACTACAAGCCAACACAATGTCATGGCAGTGT
TGGACAGTGCTGGTGTGTTGACAGATATGGAAATGAAGTCATGGGATCCAGAATAAATGGTGTTGCAGATTGTGC
TATAGATTTTGAGATCTCCGGAGATTTTGCTAGTGGCGATTTTCATGAATGGACTGATGATGAGGATGATGAAGA
CGATATTATGAATGATGAAGATGAAATTGAAGATGATGATGAAGATGAAGGGGATGATGATGATGGTGGTGATGA
CCATGATGTATACATTTGATTGATGACAGTTGAAATCAATAAATTCTACATTTCTAATATTTACAAAAATGATAG
CCTATTTAAAATTATCTTCTTCCCCAATAACAAAATGATTCTAAACCTCACATATATTTTGTATAATTATTTGAA
AAATTGCAGCTAAAGTTATAGAACTTTATGTTTAAATAAGAATCATTTGCTTTGAGTTTTTATATTCCTTACACA
AAAAGAAAATACATATGCAGTCTAGTCAGACAAAATAAAGTTTTGAAGTGCTACTATAATAAATTTTCACGAGA
ACAAACTTTGTAAATCTTCCATAAGCAAATGACAGCTAGTGCTTGGGATCGTACATGTTAATTTTTTGAAAGAT
AATTCTAAGTGAAATTTAAAATAAATAAATTTTAATGACCTGGGTCTTAAGGATTTAGGAAAAATATGCATGCT
TTAATTGCATTTCCAAAGTAGCATCTTGCTAGACCTAGATGAGTCAGGATAACAGAGAGATACCACATGACTCCA
AAAAAAAAAAAAAA
```

FIGURE 404

MLKVSAVLCVCAAAWCSQSLAAAAAVAAAGGRSDGGNFLDDKQWLTTISQYDKEVGQWNKFRD
EVEDDYFRTWSPGKPFDQALDPAKDPCLKMKCSRHKVCIAQDSQTAVCISHRRLTHRMKEAGV
DHRQWRGPILSTCKQCPVVYPSPVCGSDGHTYSFQCKLEYQACVLGKQISVKCEGHCPCPSDK
PTSTSRNVKRACSDLEFREVANRLRDWFKALHESGSQNKKTKTLLRPERSRFDTSILPICKDS
LGWMFNRLDTNYDLLLDQSELRSIYLDKNEQCTKAFFNSCDTYKDSLISNNEWCYCFQRQQDP
PCQTELSNIQKRQGVKKLLGQYIPLCDEDGYYKPTQCHGSVGQCWCVDRYGNEVMGSRINGVA
DCAIDFEISGDFASGDFHEWTDDEDDEDDIMNDEDEIEDDDEDEGDDDDGGDDHDVYI

Important features:

Signal peptide:

amino acids 1-16

Leucine zipper pattern.

amino acids 246-267

N-myristoylation sites.

amino acids 357-362, 371-376 and 376-381

Thyroglobulin type-1 repeat proteins amino acids 353-365 and 339-352

FIGURE 405

```
GGAAGGGGAGGAGCAGGCCACACAGGCACAGGCCGGTGAGGGACCTGCCCAGACCTGGAGGGTCTCGCTCTGTCA
CACAGGCTGGAGTGCAGTGGTGTGATCTTGGCTCATCGTAACCTCCACCTCCCGGGTTCAAGTGATTCTCATGCC
TCAGCCTCCCGAGTAGCTGGGATTACAGGTGGTGACTTCCAAGAGTGACTCCGTCGGAGGAAAATGACTCCCCAG
TCGCTGCTGCAGACGACACTGTTCCTGCTGAGTCTGCTCTTCCTGGTCCAAGGTGCCCACGGCAGGGGCCACAGG
GAAGACTTTCGCTTCTGCAGCCAGCGGAACCAGACACACAGGAGCAGCCTCCACTACAAACCCACACCAGACCTG
CGCATCTCCATCGAGAACTCCGAAGAGGCCCTCACAGTCCATGCCCCTTTCCCTGCAGCCCACCCTGCTTCCCGA
TCCTTCCCTGACCCCAGGGGCCTCTACCACTTCTGCCTCTACTGGAACCGACATGCTGGGAGATTACATCTTCTC
TATGGCAAGCGTGACTTCTTGCTGAGTGACAAAGCCTCTAGCCTCCTCTGCTTCCAGCACCAGGAGGAGAGCCTG
GCTCAGGGCCCCCGCTGTTAGCCACTTCTGTCACCTCCTGGTGGAGCCCTCAGAACATCAGCCTGCCCAGTGCC
GCCAGCTTCACCTTCTCCTTCCACAGTCCTCCCCACACGGCCGCTCACAATGCCTCGGTGGACATGTGCGAGCTC
AAAAGGGACCTCCAGCTGCTCAGCCAGTTCCTGAAGCATCCCCAGAAGGCCTCAAGGAGGCCCTCGGCTGCCCCC
GCCAGCCAGCAGTTGCAGAGCCTGGAGTCGAAACTGACCTCTGTGAGATTCATGGGGGACATGGTGTCCTTCGAG
GAGGACCGGATCAACGCCACGGTGTGGAAGCTCCAGCCCACAGCCGGCCTCCAGGACCTGCACATCCACTCCCGG
CAGGAGGAGGAGCAGAGCGAGATCATGGAGTACTCGGTGCTGCTGCCTCGAACACTCTTCCAGAGGACGAAAGGC
CGGAGCGGGGAGGCTGAGAAGAGACTCCTCCTGGTGGACTTCAGCAGCCAAGCCCTGTTCCAGGACAAGAATTCC
AGCCAAGTCCTGGGTGAGAAGGTCTTGGGGATTGTGGTACAGAACACCAAAGTAGCCAACCTCACGGAGCCCGTG
GTGCTCACTTTCCAGCACCAGCTACAGCCGAAGAATGTGACTCTGCAATGTGTGTTCTGGGTTGAAGACCCCACA
TTGAGCAGCCCGGGGCATTGGAGCAGTGCTGGGTGTGAGACCGTCAGGAGAGAAACCCAAACATCCTGCTTCTGC
AACCACTTGACCTACTTTGCAGTGCTGATGGTCTCCTCGGTGGAGGTGGACGCCGTGCACAAGCACTACCTGAGC
CTCCTCTCCTACGTGGGCTGTGTCGTCTCTGCCCTGGCCTGCCTTGTCACCATTGCCGCCTACCTCTGCTCCAGG
GTGCCCCTGCCGTGCAGGAGGAAACCTCGGGACTACACCATCAAGGTGCACATGAACCTGCTGCTGGCCGTCTTC
CTGCTGGACACGAGCTTCCTGCTCAGCGAGCCGGTGGCCCTGACAGGCTCTGAGGCTGGCTGCCGAGCCAGTGCC
ATCTTCCTGCACTTCTCCCTGCTCACCTGCCTTTCCTGGATGGGCCTCGAGGGGTACAACCTCTACCGACTCGTG
GTGGAGGTCTTTGGCACCTATGTCCCTGGCTACCTACTCAAGCTGAGCGCCATGGGCTGGGGCTTCCCCATCTTT
CTGGTGACGCTGGTGGCCCTGGTGGATGTGGACAACTATGCCCCATCATCTTGGCTGTGCATAGGACTCCAGAG
GGCGTCATCTACCCTTCCATGTGCTGGATCCGGGACTCCCTGGTCAGCTACATCACCAACCTGGGCCTCTTCAGC
CTGGTGTTTCTGTTCAACATGGCCATGCTAGCCACCATGGTGGTGCAGATCCTGCGGCTGCGCCCCCACACCCAA
AAGTGGTCACATGTGCTGACACTGCTGGGCCTCAGCCTGGTCCTTGGCCTGCCCTGGGCCTTGATCTTCTTCTCC
TTTGCTTCTGGCACCTTCCAGCTTGTCGTCCTCTACCTTTTCAGCATCATCACCTCCTTCCAAGGCTTCCTCATC
TTCATCTGGTACTGGTCCATGCGGCTGCAGGCCCGGGGTGGCCCCTCCCCTCTGAAGAGCAACTCAGACAGCGCC
AGGCTCCCCATCAGCTCGGGCAGCACCTCGTCCAGCCGCATCTAGGCCTCCAGCCCACCTGCCCATGTGATGAAG
CAGAGATGCGGCCTCGTCGCACACTGCCTGTGGCCCCGAGCCAGGCCCAGCCCCAGGCCAGTCAGCCGCAGACT
TTGGAAAGCCCAACGACCATGGAGAGATGGGCCGTTGCCATGGTGGACGGACTCCCGGGCTGGGCTTTTGAATTG
GCCTTGGGGACTACTCGGCTCTCACTCAGCTCCCACGGGACTCAGAAGTGCGCCGCCATGCTGCCTAGGGTACTG
TCCCCACATCTGTCCCAACCCAGCTGGAGGCCTGGTCTCTCCTTACAACCCCTGGGCCCAGCCCTCATTGCTGGG
GGCCAGGCCTTGGATCTTGAGGGTCTGGCACATCCTTAATCCTGTGCCCCTGCCTGGGACAGAAATGTGGCTCCA
GTTGCTCTGTCTCTCGTGGTCACCCTGAGGGCACTCTGCATCCTCTGTCATTTTAACCTCAGGTGGCACCCAGGG
CGAATGGGCCCAGGGCAGACCTTCAGGGCCAGAGCCCTGGCGGAGGAGAGGCCCTTTGCCAGGAGCACAGCAGC
AGCTCGCCTACCTCTGAGCCCAGGCCCCTCCCTCCCTCAGCCCCCCAGTCCTCCCTCCATCTTCCCTGGGGTTC
TCCTCCTCTCCCAGGGCCTCCTTGCTCCTTCGTTCACAGCTGGGGTCCCGATTCCAATGCTGTTTTTGGGGA
GTGGTTTCCAGGAGCTGCCTGGTGTCTGCTGTAAATGTTTGTCTACTGCACAAGCCTCGGCCTGCCCCTGAGCCA
GGCTCGGTACCGATGCGTGGGCTGGGCTAGGTCCCTCTGTCCATCTGGGCCTTTGTATGAGCTGCATTGCCCTTG
CTCACCCTGACCAAGCACACGCCTCAGAGGGGCCCTCAGCCTCTCCTGAAGCCCTCTTGTGGCAAGAACTGTGGA
CCATGCCAGTCCCGTCTGGTTTCCATCCCACCACTCCAAGGACTGAGACTGACCTCCTCTGGTGACACTGGCCTA
GAGCCTGACACTCTCCTAAGAGGTTCTCTCCAAGCCCCCAAATAGCTCCAGGCGCCCTCGGCCGCCCATCATGGT
TAATTCTGTCCAACAAACACACACGGGTAGATTGCTGGCCTGTTGTAGGTGGTAGGGACACAGATGACCGACCTG
GTCACTCCTCCTGCCAACATTCAGTCTGGTATGTGAGGCGTGCGTGAAGCAAGAACTCCTGGAGCTACAGGGACA
GGGAGCCATCATTCCTGCCTGGGAATCCTGGAAGACTTCCTGCAGGAGTCAGCGTTCAATCTTGACCTTGAAGAT
GGGAAGGATGTTCTTTTTACGTACCAATTCTTTTGTCTTTTGATATTAAAAAGAAGTACATGTTCATTGTAGAGA
ATTTGGAAACTGTAGAAGAGAATCAAGAAGAAAAATAAAAATCAGCTGTTGTAATCGCCTAGCAAAAAAAAAAAA
AAAAAAAAAAAAAAAAAAAAAAAAAAAAAAAAAAAAAAAAAAAAAAAAAAAAAAAAAAAAAAAAAAA
```

FIGURE 406

MTPQSLLQTTLFLLSLLFLVQGAHGRGHREDFRFCSQRNQTHRSSLHYKPTPDLRISIENSEE
ALTVHAPFPAAHPASRSFPDPRGLYHFCLYWNRHAGRLHLLYGKRDFLLSDKASSLLCFQHQE
ESLAQGPPLLATSVTSWWSPQNISLPSAASFTFSFHSPPHTAAHNASVDMCELKRDLQLLSQF
LKHPQKASRRPSAAPASQQLQSLESKLTSVRFMGDMVSFEEDRINATVWKLQPTAGLQDLHIH
SRQEEEQSEIMEYSVLLPRTLFQRTKGRSGEAEKRLLLVDFSSQALFQDKNSSQVLGEKVLGI
VVQNTKVANLTEPVVLTFQHQLQPKNVTLQCVFWVEDPTLSSPGHWSSAGCETVRRETQTSCF
CNHLTYFAVLMVSSVEVDAVHKHYLSLLSYVGCVVSALACLVTIAAYLCSRVPLPCRRKPRDY
TIKVHMNLLLAVFLLDTSFLLSEPVALTGSEAGCRASAIFLHFSLLTCLSWMGLEGYNLYRLV
VEVFGTYVPGYLLKLSAMGWGFPIFLVTLVALVDVDNYGPIILAVHRTPEGVIYPSMCWIRDS
LVSYITNLGLFSLVFLFNMAMLATMVVQILRLRPHTQKWSHVLTLLGLSLVLGLPWALIFFSF
ASGTFQLVVLYLFSIITSFQGFLIFIWYWSMRLQARGGPSPLKSNSDSARLPISSGSTSSSRI

Important features:
Signal peptide:
amino acids 1-25
Putative transmembrane domains:
amino acids 382-398, 402-420, 445-468, 473-491, 519-537, 568-590
and 634-657
Microbodies C-terminal targeting signal.
amino acids 691-693
cAMP- and cGMP-dependent protein kinase phosphorylation sites.
amino acids 198-201 and 370-373
N-glycosylation sites.
amino acids 39-42, 148-151, 171-174, 234-237, 303-306, 324-327
and 341-344
G-protein coupled receptors family 2 proteins
amino acids 475-504

FIGURE 407

TTGTGACTAAAAGCTGGCCTAGCAGGCCAGGGAGTGCAGCTGCAGGCGTGGGGGTGGCAGGAG
CCGCAGAGCCAGAGCAGACAGCCGAGAAACAGGTGGACAGTGTGAAAGAACCAGTGGTCTCGC
TCTGTTGCCCAGGCTAGAGTGTACTGGCGTGATCATAGCTCACTGCAGCCTCAGACTCCTGGA
CTTGAGAAATCCTCCTGCCTTAGCCTCCTGCATATCTGGGACTCCAGGGGTGCACTCAAGCCC
TGTTTCTTCTCCTTCTGTGAGTGGACCACGGAGGCTGGTGAGCTGCCTGTCATCCCAAAGCTC
AGCTCTGAGCCAGAGTGGTGGTGGCTCCACCTCTGCCGCCGGCATAGAAGCCAGGAGCAGGGC
TCTCAGAAGGCGGTGGTGCCCAGCTGGGATCATGTTGTTGGCCCTGGTCTGTCTGCTCAGCTG
CCTGCTACCCTCCAGTGAGGCCAAGCTCTACGGTCGTTGTGAACTGGCCAGAGTGCTACATGA
CTTCGGGCTGGACGGATACCGGGGATACAGCCTGGCTGACTGGGTCTGCCTTGCTTATTTCAC
AAGCGGTTTCAACGCAGCTGCTTTGGACTACGAGGCTGATGGGAGCACCAACAACGGGATCTT
CCAGATCAACAGCCGGAGGTGGTGCAGCAACCTCACCCCGAACGTCCCCAACGTGTGCCGGAT
GTACTGCTCAGATTTGTTGAATCCTAATCTCAAGGATACCGTTATCTGTGCCATGAAGATAAC
CCAAGAGCCTCAGGGTCTGGGTTACTGGGAGGCCTGGAGGCATCACTGCCAGGGAAAAGACCT
CACTGAATGGGTGGATGGCTGTGACTTCTAGGATGGACGGAACCATGCACAGCAGGCTGGGAA
ATGTGGTTTGGTTCCTGACCTAGGCTTGGGAAGACAAGCCAGCGAATAAAGGATGGTTGAACG
TGAAA

FIGURE 408

MLLALVCLLSCLLPSSEAKLYGRCELARVLHDFGLDGYRGYSLADWVCLAYFTSGFNAAALDY
EADGSTNNGIFQINSRRWCSNLTPNVPNVCRMYCSDLLNPNLKDTVICAMKITQEPQGLGYWE
AWRHHCQGKDLTEWVDGCDF

Important features:

Signal peptide:

amino acids 1-18

N-myristoylation site.

amino acids 67-72

Homolgous region to Alpha-lactalbumin / lysozyme C proteins.

amino acids 34-58 (catalytic domain), 111-132 and 66-107

FIGURE 409

```
CAGACTCCAGATTTCCCTGTCAACCACGAGGAGTCCAGAGAGGAAACGCGGAGCGGAGACAACAGTACCTGACGC
CTCTTTCAGCCCGGGATCGCCCCAGCAGGGATGGGCGACAAGATCTGGCTGCCCTTCCCCGTGCTCCTTCTGGCC
GCTCTGCCTCCGGTGCTGCTGCCTGGGGCGGCCGGCTTCACACCTTCCCTCGATAGCGACTTCACCTTTACCCTT
CCCGCCGGCCAGAAGGAGTGCTTCTACCAGCCCATGCCCCTGAAGGCCTCGCTGGAGATCGAGTACCAAGTTTTA
GATGGAGCAGGATTAGATATTGATTTCCATCTTGCCTCTCCAGAAGGCAAAACCTTAGTTTTTGAACAAAGAAAA
TCAGATGGAGTTCACACTGTAGAGACTGAAGTTGGTGATTACATGTTCTGCTTTGACAATACATTCAGCACCATT
TCTGAGAAGGTGATTTTCTTTGAATTAATCCTGGATAATATGGGAGAACAGGCACAAGAACAAGAAGATTGGAAG
AAATATATTACTGGCACAGATATATTGGATATGAAACTGGAAGACATCCTGGAATCCATCAACAGCATCAAGTCC
AGACTAAGCAAAAGTGGGCACATACAAATTCTGCTTAGAGCATTTGAAGCTCGTGATCGAAACATACAAGAAAGC
AACTTTGATAGAGTCAATTTCTGGTCTATGGTTAATTTAGTGGTCATGGTGGTGGTGTCAGCCATTCAAGTTTAT
ATGCTGAAGAGTCTGTTTGAAGATAAGAGGAAAAGTAGAACTTAAAACTCCAAACTAGAGTACGTAACATTGAAA
AATGAGGCATAAAAATGCAATAAACTGTTACAGTCAAGACCATTAATGGTCTTCTCCAAAATATTTTGAGATATA
AAAGTAGGAAACAGGTATAATTTTAATGTGAAAATTAAGTCTTCACTTTCTGTGCAAGTAATCCTGCTGATCCAG
TTGTACTTAAGTGTGTAACAGGAATATTTTGCAGAATATAGGTTTAACTGAATGAAGCCATATTAATAACTGCAT
TTTCCTAACTTTGAAAAATTTTGCAAATGTCTTAGGTGATTTAAATAAATGAGTATTGGGCCTAATTGCAACACC
AGTCTGTTTTAACAGGTTCTATTACCCAGAACTTTTTGTAAATGCGGCAGTTACAAATTAACTGTGGAAGTTT
TCAGTTTTAAGTTATAAATCACCTGAGAATTACCTAATGATGGATTGAATAAATCTTTAGACTACAAAAGCCCAA
CTTTTCTCTATTTACATATGCATCTCTCCTATAATGTAAATAGAATAATAGCTTTGAAATACAATTAGGTTTTTG
AGATTTTTATAACCAAATACATTTCAGTGTAACATATTAGCAGAAAGCATTAGTCTTTGTACTTTGCTTACATTC
CCAAAAGCTGACATTTTCACGATTCTTAAAAACACAAAGTTACACTTACTAAAATTAGGACATGTTTTCTCTTTG
AAATGAAGAATATAGTTTAAAAGCTTCCTCCTCCATAGGGACACATTTTCTCTAACCCTTAACTAAAGTGTAGGA
TTTTAAAATTAAATGTGAGGTAAAATAAGTTTATTTTTAATAGTATCTGTCAAGTTAATATCTGTCAACAGTTAA
TAATCATGTTATGTTAATTTTAACATGATTGCTGACTTGGATAATTCATTATTACCAGCAGTTATGAAGGAAATA
TTGCTAAAATGATCTGGGCCTACCATAAATAAATATCTCCTTTTCTGAGCTCTAAGAATTATCAGAAAACAGGAA
AGAATTTAGAAAAACTTGAGAAAACCTAATCCAAAATAAAATTCACTTAAGTAGAACTATAAATAAATATCTAGA
ATCTGACTGGCTCATCATGACATCCTACTCATAACATAAATCAAAGGAGATGATTAATTTCCAGTTAGCTGGAAG
AAACTTTGGCTGTATGTTTTTATTTTCTACAAGAATTCTGGTTTGAATTATTTTTGTAAGCAGGTACATTTTATA
AAATGTAAGCCCTACTGTAAGGTTTAGCACTGGGTGTACATATTTATTAAAAATTTTTATTATAACAACTTTTAT
TAAAATGGCCTTTCTGAACACTTTATTTATTGATGTTGAAGTAAGGATTAGAAACATAGACTCCCAAGTTTTAAA
CACCTAAATGTGAATAACCCATATATACAACAAAGTTTCTGCCATCTAGCTTTTTGAAGTCTATGGGGGTCTTAC
TCAAGTACTAGTAATTTAACTTCATCATGAATGAACTATAATTTTTAAGTTATGCCCATTTATAACGTTGTTTAT
GACTACATTGTGAGTTAGAAACAAACTTAAAATTTGGGGTATAGAACCCCTCAACAGGTTAGTAATGCTGGAATT
CTTGATGAGCAATAATGATAACCAGAGAGTGATTTCATTTACACTCATAGTAGTATAAAAAGAGATACATTTCCC
TCTTAGGCCCCTGGGAGAAGAGCAGCTTAGATTTCCCTACTGGCAAGGTTTTAAAAATGAGGTAAATGCCGTAT
ATGATCAATTACCTTAATTGGCCAAGAAAATGCTTCAGGTGTCTAGGGGTATCCTCTGCAACACTTGCAGAACAA
AGGTCAATAAGATCCTTGCCTATGAATACCCCTCCCTTTTGCGCTGTTAAATTTGCAATGAGAAGCAAATTTACA
GTACCATAACTAATAAAGCAGGGTACAGATATAAACTACTGCATCTTTTCTATAAAACTGTGATTAAGAATTCTA
CCTCTCCTGTATGGCTGTTACTGTACTGTACTCTCTGACTCCTTACCTAACAATGAATTTGTTACATAATCTTCT
ACATGTATGATTTGTGCCACTGATCTTAAACCTATGATTCAGTAACTTCTTACCATATAAAACGATAATTGCTT
TATTTGGAAAAGAATTTAGGAATACTAAGGACAATTATTTTTATAGACAAAGTAAAAAGACAGATATTTAAGAGG
CATAACCAAAAAGCAAAACTTGTAAACAGAGTAAAAATCTTTAATATTTCTAAAGACATACTGTTTATCTGCTT
CATATGCTTTTTTAATTTCACTATTCCATTTCTAAATTAAAGTTATGCTAAATTGAGTAAGCTGTTTATCACTT
AACAGCTCATTTGTCTTTTTCAATATACAAATTTTAAAAATACTACAATATTTAACTAAGGCCCAACCGATTTC
CATAATGTAGCAGTTACCGTGTTCACCTCACACTAAGGCCTAGAGTTTGCTCTGATATGCATTTGGATGATTAAT
GTTATGCTGTTCTTTCATGTGAATGTCAAGACATGGAGGGTGTTTGTAATTTTATGGTAAAATTAATCCTTCTTA
CACATAATGGTGTCTTAAAATTGACAAAAAATGAGCACTTACAATTGTATGTCTCCTCAAATGAAGATTCTTTAT
GTGAAATTTTAAAAGACATTGATTCCGCATGTAAGGATTTTTCATCTGAAGTACAATAATGCACAATCAGTGTTG
CTCAAACTGCTTTATACTTATAAACAGCCATCTTAAATAAGCAACGTATTGTGAGTACTGATATGTATATAATAA
AAATTATCAAAGGAAAA
```

FIGURE 410

MGDKIWLPFPVLLLAALPPVLLPGAAGFTPSLDSDFTFTLPAGQKECFYQPMPLKASLEIEYQ
VLDGAGLDIDFHLASPEGKTLVFEQRKSDGVHTVETEVGDYMFCFDNTFSTISEKVIFFELIL
DNMGEQAQEQEDWKKYITGTDILDMKLEDILESINSIKSRLSKSGHIQILLRAFEARDRNIQE
SNFDRVNFWSMVNLVVMVVVSAIQVYMLKSLFEDKRKSRT

Important features:

Signal peptide:

amino acids 1-23

Transmembrane domain:

amino acids 195-217

N-myristoylation site.

amino acids 43-48

Tyrosine kinase phosphorylation site.

amino acids 55-62

FIGURE 411

```
CCCAGCTGAGGAGCCCTGCTCAAGACACGGTCACTGGATCTGAGAAACTTCCCAGGGGACCGCATTCCAGAGTCA
GTGACTCTGTGAAGCACCCACATCTACCTCTTGCCACGTTCCCACGGGCTTGGGGGAAAGATGGTGGGGACCAAG
GCCTGGGTGTTCTCCTTCCTGGTCCTGGAAGTCACATCTGTGTTGGGGAGACAGACGATGCTCACCCAGTCAGTA
AGAAGAGTCCAGCCTGGGAAGAAGAACCCCAGCATCTTTGCCAAGCCTGCCGACACCCTGGAGAGCCCTGGTGAG
TGGACAACATGGTTCAACATCGACTACCCAGGCGGGAAGGGCGACTATGAGCGGCTGGACGCCATTCGCTTCTAC
TATGGGGACCGTGTATGTGCCCGTCCCCTGCGGCTAGAGGCTCGGACCCACTGACTGGACACCTGCGGGCAGCACT
GGCCAGGTGGTCCATGGTAGTCCCCGTGAGGGTTTCTGGTGCCTCAACAGGGAGCAGCGGCCTGGCCAGAACTGC
TCTAATTACACCGTACGCTTCCTCTGCCCACCAGGATCCCTGCGCCGAGACACAGAGCGCATCTGGAGCCCATGG
TCTCCCTGGAGCAAGTGCTCAGCTGCCTGTGGTCAGACTGGGGTCCAGACTCGCACACGCATTTGCTTGGCAGAG
ATGGTGTCGCTGTGCAGTGAGGCCAGCGAAGAGGGTCAGCACTGCATGGGCCAGGACTGTACAGCCTGTGACCTG
ACCTGCCCAATGGGCCAGGTGAATGCTGACTGTGATGCCTGCATGTGCCAGGACTTCATGCTTCATGGGGCTGTC
TCCCTTCCCGGAGGTGCCCCAGCCTCAGGGCTGCTATCTACCTCCTGACCAAGACGCCGAAGCTGCTGACCCAG
ACAGACAGTGATGGGAGATTCCGAATCCCTGGCTTGTGCCCTGATGGCAAAAGCATCCTGAAGATCACAAAGGTC
AAGTTTGCCCCCATTGTACTCACAATGCCCAAGACTAGCCTGAAGGCAGCCACCCATCAAGGCAGAGTTTGTGAGG
GCAGAGACTCCATACATGGTGATGAACCCTGAGACAAAAGCACGGAGAGCTGGGCAGAGCGTGTCTCTGTGCTGT
AAGGCCACAGGGAAGCCCAGGCCAGACAAGTATTTTTGGTATCATAATGACACATTGCTGGATCCTTCCCTCTAC
AAGCATGAGAGCAAGCTGGTGCTGAGGAAACTGCAGCAGCACCAGGCTGGGGAGTACTTTTGCAAGGCCCAGAGT
GATGCTGGGGCTGTGAAGTCCAAGGTTGCCCAGCTGATTGTCACAGCATCTGATGAGACTCCTTGCAACCCAGTT
CCTGAGAGCTATCTTATCCGGCTGCCCCATGATTGCTTTCAGAATGCCACCAACTCCTTCTACTATGACGTGGGA
CGCTGCCCTGTTAAGACTTGTGCAGGGCAGCAGGATAATGGGATCAGGTGCCGTGATGCTGTGCAGAACTGCTGT
GGCATCTCCAAGACAGAGGAAAGGGAGATCCAGTGCAGTGGCTACACGCTACCCACCAAGGTGGCCAAGGAGTGC
AGCTGCCAGCGGTGTACGGAAACTCGGAGCATCGGTGCGGGGCCTGTCAGTGCTGCTGACAATGGGGAGCCCATG
CGCTTTGGCCATGTGTACATGGGGAACAGCCGTGTAAGCATGACTGGCTACAAGGGCACTTTCACCCTCCATGTC
CCCCAGGACACTGAGAGGCTGGTGCTCACATTTGTGGACAGGCTGCAGAAGTTTGTCAACACCACCAAAGTGCTA
CCTTTCAACAAGAAGGGGAGTGCCGTGTTCCATGAAATCAAGATGCTTCGTCGGAAAGAGCCCATCACTTTGGAA
GCCATGGAGACCAACATCATCCCCCTGGGGGAAGTGGTTGGTGAAGACCCCATGGCTGAACTGGAGATTCCATCC
AGGAGTTTCTACAGGCAGAATGGGGAGCCCTACATAGGAAAAGTGAAGGCCAGTGTGACCTTCCTGGATCCCCGG
AATATTTCCACAGCCACAGCTGCCCAGACTGACCTGAACTTCATCAATGACGAAGGAGACACTTTCCCCCTTCGG
ACGTATGCCATGTTCTCTGTGGACTTCAGAGATGAGGTCACCTCAGAGCCACTTAATGCTGGCAAAGTGAAGGTC
CACCTTGACTCGACCCAGGTCAAGATGCCAGAGCACATATCCACAGTGAAACTCTGGTCACTCAATCCAGACACA
GGGCTGTGGGAGGAGGAAGGTGATTTCAAATTTGAAAATCAAAGGAGGAACAAAAGAGAAGACAGAACCTTCCTG
GTGGGCAACCTGGAGATTCGTGAGAGGAGGCTCTTTAACCTGGATGTTCCTGAAAGCAGGCGGTGCTTTGTTAAG
GTGAGGGCCTACCGGAGTGAGAGGTTCTTGCCTAGTGAGCAGATCCAGGGGGTTGTGATCTCCGTGATTAACCTG
GAGCCTAGAACTGGCTTCTTGTCCAACCCTAGGGCCTGGGGCCGCTTTGACAGTGTCATCACAGGCCCCAACGGG
GCCTGTGTGCCTGCCTTCTGTGATGACCAGTCCCCTGATGCCTACTCTGCCTATGTCTTGGCAAGCCTGGCTGGG
GAGGAACTGCAAGCAGTGGAGTCTTCTCCTAAATTCAACCCAAATGCAATTGGCGTCCCTCAGCCCTATCTCAAC
AAGCTCAACTACCGTCGGACGGACCATGAGGATCCACGGGTTAAAAAGACAGCTTTCCAGATTAGCATGGCCAAG
CCAAGGCCCAACTCAGCTGAGGAGAGCAATGGGCCCATCTATGCCTTTGAGAACCTCCGGGCATGTGAAGAGGCA
CCACCCAGTGCAGCCCACTTCCGGTTCTACCAGATTGAGGGGGATCGATATGACTACCAACACAGTCCCCCTTCAAC
GAAGATGACCCTATGAGCTGGACTGAAGACTATCTGGCATGGTGGCCAAAGCCGATGGAATTCAGGGCCTGCTAT
ATCAAGGTGAAGATTGTGGGGCCACTGGAAGTGAATGTGCGATCCCGCCAACATGGGGGGCACTCATCGGCGGACA
GTGGGGAAGCTGTATGGAATCCGAGATGTGAGGAGCACTCGGGACAGGGACCAGCCCAATGTCTCAGCTGCCTGT
CTGGAGTTCAAGTGCAGTGGGATGCTCTATGATCAGGACCGTGTGGACCGCACCCTGGTGAAGGTCATCCCCCAG
GGCAGCTGCCGTCGAGCCAGTGTGAACCCCATGCTGCATGAGTACCTGGTCAACCACTTGCCACTTGCAGTCAAC
AACGACACCAGTGAGTACACCATGCTGGCACCCTTGGACCCACAGGGACCAATGTCTACACTGTCACT
GACCAGGACCCTCGCACGGCCAAGGAGATCGCGCTCGGCCGGTGCTTTGATGGCACATCCGATGGCTCCTCCAGA
ATCATGAAGAGCAATGTGGGAGTAGCCCTCACCTTCAACTGTGTAGAGAGGCAAGTAGGCCGCCAGAGTGCCTTC
CAGTACCTCCAAAGCACCCCAGCCCAGTCCCCTGCTGCAGGCACTGTCCAAGGAAGAGTGCCCTCGAGGAGGGCA
CAGCGAGCGAGCAGGGGTGGCCAGCGCCAGGGTGGAGTGGTGGCCTCTCTGAGATTTCCTAGAGTTGCTCAACAG
CCCCTGATCAACTAAGTTTTGTGGTACTTCACCCTCTTCTGCCCTCATTTCATGTGACAGCCATTGTGAGACTGA
TGCACAAACTGTCACTTGGTTAATTTAAGCACTTCTGTTTTCGTGAATTTGCTTGTTTGTTTCTTCATGCCTTTA
CTTACTTTGTCCCATGCTACTGATTGGCACGTGGCCCCCACAATGGCACAATAAAGCCCCTTTGTGAAACTGTTC
TTTAAATGAAACACAAGAAATTGGCCACTGGTAAAACTCTGCAGCTTCAACTGTACTTCATTTAATGCCATTAAT
GCAAATATACTTCCTCTTCTTTTTGCATGGTTTTGCCCACCTCTGCAATAGTGATAATCTGATGCTGAAGATCAA
ATAACCAATATAAAGCATATTTCTTGGCCTTGCTCCACAGGACATAGGCCAAGCCTTGATCATAGTTCATACATAT
AAATGGTGGTGAAATAAAGAAATAAAACACAATACTTTTACTTGAAATGTAAATAACTTATTTATTTCTTTGCTA
AATTTGGAATTCTAGTGCACATTCAAAGTTAAGCTATTAAATATAGGGTGATCATAGTTCCTCTACCAAGTCTGG
AAAGAACATCTCCTGGTATCCACAATTACACCAGGTTGCTAACTGTATTTGTACATTTCCCTTTGCATTCGCTTT
TGTTCTTGCTAGAAACCCAGTGTAGCCCAGGGCAGATGTCAATAAATGCATACTCTGTATTTCGAAAAAA
```

FIGURE 412

MVGTKAWVFSFLVLEVTSVLGRQTMLTQSVRRVQPGKKNPSIFAKPADTLESPGEWTTWFNID
YPGGKGDYERLDAIRFYYGDRVCARPLRLEARTTDWTPAGSTGQVVHGSPREGFWCLNREQRP
GQNCSNYTVRFLCPPGSLRRDTERIWSPWSPWSKCSAACGQTGVQTRTRICLAEMVSLCSEAS
EEGQHCMGQDCTACDLTCPMGQVNADCDACMCQDFMLHGAVSLPGGAPASGAAIYLLTKTPKL
LTQTDSDGRFRIPGLCPDGKSILKITKVKFAPIVLTMPKTSLKAATIKAEFVRAETPYMVMNP
ETKARRAGQSVSLCCKATGKPRPDKYFWYHNDTLLDPSLYKHESKLVLRKLQQHQAGEYFCKA
QSDAGAVKSKVAQLIVTASDETPCNPVPESYLIRLPHDCFQNATNSFYYDVGRCPVKTCAGQQ
DNGIRCRDAVQNCCGISKTEEREIQCSGYTLPTKVAKECSCQRCTETRSIVRGRVSAADNGEP
MRFGHVYMGNSRVSMTGYKGTFTLHVPQDTERLVLTFVDRLQKFVNTTKVLPFNKKGSAVFHE
IKMLRRKEPITLEAMETNIIPLGEVVGEDPMAELEIPSRSFYRQNGEPYIGKVKASVTFLDPR
NISTATAAQTDLNFINDEGDTFPLRTYGMFSVDFRDEVTSEPLNAGKVKVHLDSTQVKMPEHI
STVKLWSLNPDTGLWEEEGDFKFENQRRNKREDRTFLVGNLEIRERRLFNLDVPESRRCFVKV
RAYRSERFLPSEQIQGVVISVINLEPRTGFLSNPRAWGRFDSVITGPNGACVPAFCDDQSPDA
YSAYVLASLAGEELQAVESSPKFNPNAIGVPQPYLNKLNYRRTDHEDPRVKKTAFQISMAKPR
PNSAEESNGPIYAFENLRACEEAPPSAAHFRFYQIEGDRYDYNTVPFNEDDPMSWTEDYLAWW
PKPMEFRACYIKVKIVGPLEVNVRSRNMGGTHRRTVGKLYGIRDVRSTRDRDQPNVSAACLEF
KCSGMLYDQDRVDRTLVKVIPQGSCRRASVNPMLHEYLVNHLPLAVNNDTSEYTMLAPLDPLG
HNYGIYTVTDQDPRTAKEIALGRCFDGTSDGSSRIMKSNVGVALTFNCVERQVGRQSAFQYLQ
STPAQSPAAGTVQGRVPSRRQQRASRGGQRQGGVVASLRFPRVAQQPLIN

FIGURE 413

GCCACGTTGTCTTCTTTCCTTCACCACCACCCAGGAGCTCAGAGATCTAAGCTGCTTTCCATC
TTTTCTCCCAGCCCCAGGACACTGACTCTGTACAGGATGGGGCCGTCCTCTTGCCTCCTTCTC
ATCCTAATCCCCCTTCTCCAGCTGATCAACCCGGGGAGTACTCAGTGTTCCTTAGACTCCGTT
ATGGATAAGAAGATCAAGGATGTTCTCAACAGTCTAGAGTACAGTCCCTCTCCTATAAGCAAG
AAGCTCTCGTGTGCTAGTGTCAAAAGCCAAGGCAGACCGTCCTCCTGCCCTGCTGGGATGGCT
GTCACTGGCTGTGCTTGTGGCTATGGCTGTGGTTCGTGGGATGTTCAGCTGGAAACCACCTGC
CACTGCCAGTGCAGTGTGGTGGACTGGACCACTGCCCGCTGCTGCCACCTGACCTGACAGGGA
GGAGGCTGAGAACTCAGTTTTGTGACCATGACAGTAATGAAACCAGGGTCCCAACCAAGAAAT
CTAACTCAAACGTCCCACTTCATTTGTTCCATTCCTGATTCTTGGGTAATAAAGACAAACTTT
GTACCTCAAAAAAAAAAAAAAAAAAAAAA

FIGURE 414

MGPSSCLLLILIPLLQLINPGSTQCSLDSVMDKKIKDVLNSLEYSPSPISKKLSCASVKS
QGRPSSCPAGMAVTGCACGYGCGSWDVQLETTCHCQCSVVDWTTARCCHLT

FIGURE 415

CAGAAGAGGGGGCTAGCTAGCTGTCTCTGCGGACCAGGGAGACCCCCGCGCCCCCCGGTGTG
AGGCGGCCTCACAGGGCCGGGTGGGCTGGCGAGCCGACGCGGCGGCGGAGGAGGCTGTGAGGA
GTGTGTGGAACAGGACCCGGGACAGAGGAACC<u>ATG</u>GCTCCGCAGAACCTGAGCACCTTTTGCC
TGTTGCTGCTATACCTCATCGGGGCGGTGATTGCCGGACGAGATTTCTATAAGATCTTGGGGG
TGCCTCGAAGTGCCTCTATAAAGGATATTAAAAGGCCTATAGGAAACTAGCCCTGCAGCTTC
ATCCCGACCGGAACCCTGATGATCCACAAGCCCAGGAGAAATTCCAGGATCTGGGTGCTGCTT
ATGAGGTTCTGTCAGATAGTGAGAAACGGAAACAGTACGATACTTATGGTGAAGAAGGATTAA
AAGATGGTCATCAGAGCTCCCATGGAGACATTTTTTCACACTTCTTTGGGGATTTTGGTTTCA
TGTTTGGAGGAACCCCTCGTCAGCAAGACAGAAATATTCCAAGAGGAAGTGATATTATTGTAG
ATCTAGAAGTCACTTTGGAAGAAGTATATGCAGGAAATTTTGTGGAAGTAGTTAGAAACAAAC
CTGTGGCAAGGCAGGCTCCTGGCAAACGGAAGTGCAATTGTCGGCAAGAGATGCGGACCACCC
AGCTGGGCCCTGGGCGCTTCCAAATGACCCAGGAGGTGGTCTGCGACGAATGCCCTAATGTCA
AACTAGTGAATGAAGAACGAACGCTGGAAGTAGAAATAGAGCCTGGGGTGAGAGACGGCATGG
AGTACCCCTTTATTGGAGAAGGTGAGCCTCACGTGGATGGGGAGCCTGGAGATTTACGGTTCC
GAATCAAAGTTGTCAAGCACCCAATATTTGAAAGGAGAGGAGATGATTTGTACACAAATGTGA
CAATCTCATTAGTTGAGTCACTGGTTGGCTTTGAGATGGATATTACTCACTTGGATGGTCACA
AGGTACATATTTCCCGGGATAAGATCACCAGGCCAGGAGCGAAGCTATGGAAGAAAGGGGAAG
GGCTCCCCAACTTTGACAACAACAATATCAAGGGCTCTTTGATAATCACTTTTGATGTGGATT
TTCCAAAAGAACAGTTAACAGAGGAAGCGAGAGAAGGTATCAAACAGCTACTGAAACAAGGGT
CAGTGCAGAAGGTATACAATGGACTGCAAGGATAT<u>TGA</u>GAGTGAATAAAATTGGACTTTGTTT
AAAATAAGTGAATAAGCGATATTTATTATCTGCAAGGTTTTTTGTGTGTTTTTGTTTTA
TTTTCAATATGCAAGTTAGGCTTAATTTTTTATCTAATGATCATCATGAAATGAATAAGAGG
GCTTAAGAATTTGTCCATTTGCATTCGGAAAAGAATGACCAGCAAAAGGTTTACTAATACCTC
TCCCTTTGGGGATTTAATGTCTGGTGCTGCCGCCTGAGTTTCAAGAATTAAAGCTGCAAGAGG
ACTCCAGGAGCAAAAGAAACACAATATAGAGGGTTGGAGTTGTTAGCAATTTCATTCAAAATG
CCAACTGGAGAAGTCTGTTTTTAAATACATTTTGTTGTTATTTTA

FIGURE 416

MAPQNLSTFCLLLLYLIGAVIAGRDFYKILGVPRSASIKDIKKAYRKLALQLHPDRNPDDPQAQEKFQDLGAAYE
VLSDSEKRKQYDTYGEEGLKDGHQSSHGDIFSHFFGDFGFMFGGTPRQQDRNIPRGSDIIVDLEVTLEEVYAGNF
VEVVRNKPVARQAPGKRKCNCRQEMRTTQLGPGRFQMTQEVVCDECPNVKLVNEERTLEVEIEPGVRDGMEYPFI
GEGEPHVDGEPGDLRFRIKVVKHPIFERRGDDLYTNVTISLVESLVGFEMDITHLDGHKVHISRDKITRPGAKLW
KKGEGLPNFDNNNIKGSLIITFDVDFPKEQLTEEAREGIKQLLKQGSVQKVYNGLQGY

Important features:
Signal peptide:
amino acids 1-22

Cell attachment sequence.
amino acids 254-257

Nt-dnaJ domain signature.
amino acids 67-87

Homologous region to Nt-dnaJ domain proteins.
amino acids 26-58

N-glycosylation site.
amino acids 5-9, 261-265

Tyrosine kinase phosphorylation site.
amino acids 253-260

N-myristoylation site.
amino acids 18-24, 31-37, 93-99, 215-221

Amidation site.
amino acids 164-168

FIGURE 417

CGGCGGCGGCTGCGGGCGCGAGGTGAGGGGCGCGAGGTGAGGGGCGCGAGGTTCCCAGCAGGA
TGCCCCGGCTCTGCAGGAAGCTGAAGTGAGAGGCCCGGAGAGGGCCCAGCCCGCCCGGGGCAG
G<u>ATG</u>ACCAAGGCCCGGCTGTTCCGGCTGTGGCTGGTGCTGGGGTCGGTGTTCATGATCCTGCT
GATCATCGTGTACTGGGACAGCGCAGGCGCCGCGCACTTCTACTTGCACACGTCCTTCTCTAG
GCCGCACACGGGGCCGCCGCTGCCCACGCCCGGGCCGGACAGGGACAGGGAGCTCACGGCCGA
CTCCGATGTCGACGAGTTTCTGGACAAGTTTCTCAGTGCTGGCGTGAAGCAGAGCGACCTTCC
CAGAAAGGAGACGGAGCAGCCGCCTGCGCCGGGGAGCATGGAGGAGAGCGTGAGAGGCTACGA
CTGGTCCCCGCGCGACGCCCGGCGCAGCCCAGACCAGGGCCGGCAGCAGGCGGAGCGGAGGAG
CGTGCTGCGGGCTTCTGCGCCAACTCCAGCCTGGCCTTCCCCACCAAGGAGCGCGCATTCGA
CGACATCCCCAACTCGGAGCTGAGCCACCTGATCGTGGACGACCGGCACGGGGCCATCTACTG
CTACGTGCCCAAGGTGGCCTGCACCAACTGGAAGCGCGTGATGATCGTGCTGAGCGGAAGCCT
GCTGCACCGCGGTGCGCCCTACCGCGACCCGCTGCGCATCCCGCGCGAGCACGTGCACAACGC
CAGCGCGCACCTGACCTTCAACAAGTTCTGGCGCCGCTACGGGAAGCTCTCCCGCCACCTCAT
GAAGGTCAAGCTCAAGAAGTACACCAAGTTCCTCTTCGTGCGCGACCCCTTCGTGCGCCTGAT
CTCCGCCTTCCGCAGCAAGTTCGAGCTGGAGAACGAGGAGTTCTACCGCAAGTTCGCCGTGCC
CATGCTGCGGCTGTACGCCAACCACACCAGCCTGCCCGCCTCGGCGCGCGAGGCCTTCCGCGC
TGGCCTCAAGGTGTCCTTCGCCAACTTCATCCAGTACCTGCTGGACCCGCACACGGAGAAGCT
GGCGCCCTTCAACGAGCACTGGCGGCAGGTGTACCGCCTCTGCCACCCGTGCCAGATCGACTA
CGACTTCGTGGGGAAGCTGGAGACTCTGGACGAGGACGCCGCGCAGCTGCTGCAGCTACTCCA
GGTGGACCGGCAGCTCCGCTTCCCCCCGAGCTACCGGAACAGGACCGCCAGCAGCTGGGAGGA
GGACTGGTTCGCCAAGATCCCCCTGGCCTGGAGGCAGCAGCTGTATAAACTCTACGAGGCCGA
CTTTGTTCTCTTCGGCTACCCCAAGCCCGAAAACCTCCTCCGAGAC<u>TGA</u>AAGCTTTCGCGTTG
CTTTTTCTCGCGTGCCTGGAACCTGACGCACGCGCACTCCAGTTTTTTTATGACCTACGATTT
TGCAATCTGGGCTTCTTGTTCACTCCACTGCCTCTATCCATTGAGTACTGTATCGATATTGTT
TTTTAAGATTAATATATTTCAGGTATTTAATACGA

FIGURE 418

MTKARLFRLWLVLGSVFMILLIIVYWDSAGAAHFYLHTSFSRPHTGPPLPTPGPDRDRELTAD
SDVDEFLDKFLSAGVKQSDLPRKETEQPPAPGSMEESVRGYDWSPRDARRSPDQGRQQAERRS
VLRGFCANSSLAFPTKERAFDDIPNSELSHLIVDDRHGAIYCYVPKVACTNWKRVMIVLSGSL
LHRGAPYRDPLRIPREHVHNASAHLTFNKFWRRYGKLSRHLMKVKLKKYTKFLFVRDPFVRLI
SAFRSKFELENEEFYRKFAVPMLRLYANHTSLPASAREAFRAGLKVSFANFIQYLLDPHTEKL
APFNEHWRQVYRLCHPCQIDYDFVGKLETLDEDAAQLLQLLQVDRQLRFPPSYRNRTASSWEE
DWFAKIPLAWRQQLYKLYEADFVLFGYPKPENLLRD

Important features:
Signal peptide:
amino acids 1-31

N-glycosylation sites.
amino acids 134-137, 209-212, 280-283 and 370-373

TNFR/NGFR family cysteine-rich region protein
amino acids 329-332

FIGURE 419

```
GGCACGAGGCTGAACCCAGCCGGCTCCATCTCAGCTTCTGGTTTCTAAGTCCATGTGCCAAAG
GCTGCCAGGAAGGAGACGCCTTCCTGAGTCCTGGATCTTTCTTCCTTCTGGAAATCTTTGACT
GTGGGTAGTTATTTATTTCTGAATAAGAGCGTCCACGCATCATGGACCTCGCGGGACTGCTGA
AGTCTCAGTTCCTGTGCCACCTGGTCTTCTGCTACGTCTTTATTGCCTCAGGGCTAATCATCA
ACACCATTCAGCTCTTCACTCTCCTCCTCTGGCCCATTAACAAGCAGCTCTTCCGGAAGATCA
ACTGCAGACTGTCCTATTGCATCTCAAGCCAGCTGGTGATGCTGCTGGAGTGGTGGTCGGGCA
CGGAATGCACCATCTTCACGGACCCGCGCGCCTACCTCAAGTATGGGAAGGAAAATGCCATCG
TGGTTCTCAACCACAAGTTTGAAATTGACTTTCTGTGTGGCTGGAGCCTGTCCGAACGCTTTG
GGCTGTTAGGGGGCTCCAAGGTCCTGGCCAAGAAAGAGCTGGCCTATGTCCCAATTATCGGCT
GGATGTGGTACTTCACCGAGATGGTCTTCTGTTCGCGCAAGTGGGAGCAGGATCGCAAGACGG
TTGCCACCAGTTTGCAGCACCTCCGGGACTACCCCGAGAAGTATTTTTTCCTGATTCACTGTG
AGGGCACACGGTTCACGGAGAAGAAGCATGAGATCAGCATGCAGGTGGCCCGGGCCAAGGGGC
TGCCTCGCCTCAAGCATCACCTGTTGCCACGAACCAAGGGCTTCGCCATCACCGTGAGGAGCT
TGAGAAATGTAGTTTCAGCTGTATATGACTGTACACTCAATTTCAGAAATAATGAAAATCCAA
CACTGCTGGGAGTCCTAAACGGAAAGAAATACCATGCAGATTTGTATGTTAGGAGGATCCCAC
TGGAAGACATCCCTGAAGACGATGACGAGTGCTCGGCCTGGCTGCACAAGCTCTACCAGGAGA
AGGATGCCTTTCAGGAGGAGTACTACAGGACGGGCACCTTCCCAGAGACGCCCATGGTGCCCC
CCCGGCGGCCCTGGACCCTCGTGAACTGGCTGTTTTGGGCCTCGCTGGTGCTCTACCCTTTCT
TCCAGTTCCTGGTCAGCATGATCAGGAGCGGGTCTTCCCTGACGCTGGCCAGCTTCATCCTCG
TCTTCTTTGTGGCCTCCGTGGGAGTTCGATGGATGATTGGTGTGACGGAAATTGACAAGGGCT
CTGCCTACGGCAACTCTGACAGCAAGCAGAAACTGAATGACTGACTCAGGGAGGTGTCACCAT
CCGAAGGGAACCTTGGGGAACTGGTGGCCTCTGCATATCCTCCTTAGTGGGACACGGTGACAA
AGGCTGGGTGAGCCCCTGCTGGGCACGGCGGAAGTCACGACCTCTCCAGCCAGGGAGTCTGGT
CTCAAGGCCGGATGGGGAGGAAGATGTTTTGTAATCTTTTTTTCCCCATGTGCTTTAGTGGGC
TTTGGTTTTCTTTTTGTGCGAGTGTGTGTGAGAATGGCTGTGTGGTGAGTGTGAACTTTGTTC
TGTGATCATAGAAAGGGTATTTTAGGCTGCAGGGGAGGGCAGGGCTGGGGACCGAAGGGGACA
AGTTCCCCTTTCATCCTTTGGTGCTGAGTTTTCTGTAACCCTTGGTTGCCAGAGATAAAGTGA
AAAGTGCTTTAGGTGAGATGACTAAATTATGCCTCCAAGAAAAAAAAATTAAAGTGCTTTTCT
GGGTCAAAAAAAAAAAA
```

FIGURE 420

MDLAGLLKSQFLCHLVFCYVFIASGLIINTIQLFTLLLWPINKQLFRKINCRLSYCISSQLVM
LLEWWSGTECTIFTDPRAYLKYGKENAIVVLNHKFEIDFLCGWSLSERFGLLGGSKVLAKKEL
AYVPIIGWMWYFTEMVFCSRKWEQDRKTVATSLQHLRDYPEKYFFLIHCEGTRFTEKKHEISM
QVARAKGLPRLKHHLLPRTKGFAITVRSLRNVVSAVYDCTLNFRNNENPTLLGVLNGKKYHAD
LYVRRIPLEDIPEDDDECSAWLHKLYQEKDAFQEEYYRTGTFPETPMVPPRRPWTLVNWLFWA
SLVLYPFFQFLVSMIRSGSSLTLASFILVFFVASVGVRWMIGVTEIDKGSAYGNSDSKQKLND

FIGURE 421

CGGACGCGTGGGCGGACGCGTGGGCGGACGCGTGGGCGGACGCGTGGGCTGGGTGCCTGCATC
GCC<u>ATG</u>GACACCACCAGGTACAGCAAGTGGGGCGGCAGCTCCGAGGAGGTCCCCGGAGGGCCC
TGGGGACGCTGGGTGCACTGGAGCAGGAGACCCCTCTTCTTGGCCCTGGCTGTCCTGGTCACC
ACAGTCCTTTGGGCTGTGATTCTGAGTATCCTATTGTCCAAGGCCTCCACGGAGCGCGCGGCG
CTGCTTGACGGCCACGACCTGCTGAGGACAAACGCCTCGAAGCAGACGGCGGCGCTGGGTGCC
CTGAAGGAGGAGGTCGGAGACTGCCACAGCTGCTGCTCGGGACGCAGGCGCAGCTGCAGACC
ACGCGCGCGGAGCTTGGGGAGGCGCAGGCGAAGCTGATGGAGCAGGAGAGCGCCCTGCGGGAA
CTGCGTGAGCGCGTGACCCAGGGCTTGGCTGAAGCCGGCAGGGGCCGTGAGGACGTCCGCACT
GAGCTGTTCCGGGCGCTGGAGGCCGTGAGGCTCCAGAACAACTCCTGCGAGCCGTGCCCCACG
TCGTGGCTGTCCTTCGAGGGCTCCTGCTACTTTTTCTCTGTGCCAAAGACGACGTGGGCGGCG
GCGCAGGATCACTGCGCAGATGCCAGCGCGCACCTGGTGATCGTTGGGGGCCTGGATGAGCAG
GGCTTCCTCACTCGGAACACGCGTGGCCGTGGTTACTGGCTGGGCCTGAGGGCTGTGCGCCAT
CTGGGCAAGGTTCAGGGCTACCAGTGGGTGGACGGAGTCTCTCTCAGCTTCAGCCACTGGAAC
CAGGGAGAGCCCAATGACGCTTGGGGGCGCGAGAACTGTGTCATGATGCTGCACACGGGGCTG
TGGAACGACGCACCGTGTGACAGCGAGAAGGACGGCTGGATCTGTGAGAAAAGGCACAACTGC
<u>TGA</u>CCCCGCCCAGTGCCCTGGAGCCGCGCCCATTGCAGCATGTCGTATCCTGGGGGCTGCTCA
CCTCCCTGGCTCCTGGAGCTGATTGCCAAAGAGTTTTTTCTTCCTCATCCACCGCTGCTGAG
TCTCAGAAACACTTGGCCCAACATAGCCCTGTCCAGCCCAGTGCCTGGGCTCTGGGACCTCCA
TGCCGACCTCATCCTAACTCCACTCACGCAGACCCAACCTAACCTCCACTAGCTCCAAAATCC
CTGCTCCTGCGTCCCCGTGATATGCCTCCACTTCTCTCCCTAACCAAGGTTAGGTGACTGAGG
ACTGGAGCTGTTTGGTTTTCTCGCATTTTCCACCAAACTGGAAGCTGTTTTTGCAGCCTGAGG
AAGCATCAATAAATATTTGAGAAATGAAAAAA

FIGURE 422

MDTTRYSKWGGSSEEVPGGPWGRWVHWSRRPLFLALAVLVTTVLWAVILSILLSKASTERAAL
LDGHDLLRTNASKQTAALGALKEEVGDCHSCCSGTQAQLQTTRAELGEAQAKLMEQESALREL
RERVTQGLAEAGRGREDVRTELFRALEAVRLQNNSCEPCPTSWLSFEGSCYFFSVPKTTWAAA
QDHCADASAHLVIVGGLDEQGFLTRNTRGRGYWLGLRAVRHLGKVQGYQWVDGVSLSFSHWNQ
GEPNDAWGRENCVMMLHTGLWNDAPCDSEKDGWICEKRHNC

Important features:

Type II transmembrane domain:
amino acids 31-54

N-glycosylation sites.
amino acids 73-76 and 159-162

Leucine zipper pattern.
amino acids 102-123

N-myristoylation sites.
amino acids 18-23, 133-138 and 242-247

C-type lectin domain signature.
amino acids 264-287

FIGURE 423

```
GCGCCGCCAGGCGTAGGCGGGGTGGCCCTTGCGTCTCCCGCTTCCTTGAAAAACCCGGCGGGC
GAGCGAGGCTGCGGGCCGGCCGCTGCCCTTCCCCACACTCCCCGCCGAGAAGCCTCGCTCGGC
GCCCAACATGGCGGGTGGGCGCTGCGGCCCGCAGCTAACGGCGCTCCTGGCCGCCTGGATCGC
GGCTGTGGCGGCGACGGCAGGCCCCGAGGAGGCCGCGCTGCCGCCGGAGCAGAGCCGGGTCCA
GCCCATGACCGCCTCCAACTGGACGCTGGTGATGGAGGGCGAGTGGATGCTGAAATTTTACGC
CCCATGGTGTCCATCCTGCCAGCAGACTGATTCAGAATGGGAGGCTTTTGCAAAGAATGGTGA
AATACTTCAGATCAGTGTGGGGAAGGTAGATGTCATTCAAGAACCAGGTTTGAGTGGCCGCTT
CTTTGTCACCACTCTCCCAGCATTTTTTCATGCAAAGGATGGGATATTCCGCCGTTATCGTGG
CCCAGGAATCTTCGAAGACCTGCAGAATTATATCTTAGAGAAGAAATGGCAATCAGTCGAGCC
TCTGACTGGCTGGAAATCCCCAGCTTCTCTAACGATGTCTGGAATGGCTGGTCTTTTTAGCAT
CTCTGGCAAGATATGGCATCTTCACAACTATTTCACAGTGACTCTTGGAATTCCTGCTTGGTG
TTCTTATGTGTTTTCGTCATAGCCACCTTGGTTTTGGCCTTTTTATGGGTCTGGTCTTGGT
GGTAATATCAGAATGTTTCTATGTGCCACTTCCAAGGCATTTATCTGAGCGTTCTGAGCAGAA
TCGGAGATCAGAGGAGGCTCATAGAGCTGAACAGTTGCAGGATGCGGAGGAGGAAAAGATGA
TTCAAATGAAGAAGAAAACAAAGACAGCCTTGTAGATGATGAAGAAGAGAAAGAAGATCTTGG
CGATGAGGATGAAGCAGAGGAAGAAGAGGAGGAGGACAACTTGGCTGCTGGTGTGGATGAGGA
GAGAAGTGAGGCCAATGATCAGGGGCCCCAGGAGAGGACGGTGTGACCCGGGAGGAAGTAGA
GCCTGAGGAGGCTGAAGAAGGCATCTCTGAGCAACCCTGCCCAGCTGACACAGAGGTGGTGGA
AGACTCCTTGAGGCAGCGTAAAAGTCAGCATGCTGACAAGGGACTGTAGATTTAATGATGCGT
TTTCAAGAATACACACCAAAACAATATGTCAGCTTCCCTTTGGCCTGCAGTTTGTACCAAATC
CTTAATTTTTCCTGAATGAGCAAGCTTCTCTTAAAAGATGCTCTCTAGTCATTTGGTCTCATG
GCAGTAAGCCTCATGTATACTAAGGAGAGTCTTCCAGGTGTGACAATCAGGATATAGAAAAAC
AAACGTAGTGTTGGGATCTGTTTGGAGACTGGGATGGGAACAAGTTCATTTACTTAGGGGTCA
GAGAGTCTCGACCAGAGGAGGCCATTCCCAGTCCTAATCAGCACCTTCCAGAGACAAGGCTGC
AGGCCCTGTGAAATGAAAGCCAAGCAGGAGCCTTGGCTCCTGAGCATCCCCAAAGTGTAACGT
AGAAGCCTTGCATCCTTTTCTTGTGTAAAGTATTTATTTTTGTCAAATTGCAGGAAACATCAG
GCACCACAGTGCATGAAAAATCTTTCACAGCTAGAAATTGAAAGGGCCTTGGGTATAGAGAGC
AGCTCAGAAGTCATCCCAGCCCTCTGAATCTCCTGTGCTATGTTTTATTTCTTACCTTTAATT
TTTCCAGCATTTCCACCATGGGCATTCAGGCTCTCCACACTCTTCACTATTATCTCTTGGTCA
GAGGACTCCAATAACAGCCAGGTTTACATGAACTGTGTTTGTTCATTCTGACCTAAGGGGTTT
AGATAATCAGTAACCATAACCCCTGAAGCTGTGACTGCCAAACATCTCAAATGAAATGTTGTG
GCCATCAGAGACTCAAAAGGAAGTAAGGATTTTACAAGACAGATTAAAAAAAAATTGTTTTGT
CCAAAATATAGTTGTTGTTGATTTTTTTTAAGTTTTCTAAGCAATATTTTTCAAGCCAGAAG
TCCTCTAAGTCTTGCCAGTACAAGGTAGTCTTGTGAAGAAAGTTGAATACTGTTTGTTTTC
ATCTCAAGGGGTTCCCTGGGTCTTGAACTACTTTAATAATAACTAAAAAACCACTTCTGATTT
TCCTTCAGTGATGTGCTTTTGGTGAAAGAATTAATGAACTCCAGTACCTGAAAGTGAAAGATT
TGATTTTGTTTCCATCTTCTGTAATCTTCCAAAGAATTATATCTTTGTAAATCTCTCAATACT
CAATCTACTGTAAGTACCCAGGGAGGCTAATTTCTTT
```

FIGURE 424

MAGGRCGPQLTALLAAWIAAVAATAGPEEAALPPEQSRVQPMTASNWTLVMEGEWMLKFYAPW
CPSCQQTDSEWEAFAKNGEILQISVGKVDVIQEPGLSGRFFVTTLPAFFHAKDGIFRRYRGPG
IFEDLQNYILEKKWQSVEPLTGWKSPASLTMSGMAGLFSISGKIWHLHNYFTVTLGIPAWCSY
VFFVIATLVFGLFMGLVLVVISECFYVPLPRHLSERSEQNRRSEEAHRAEQLQDAEEEKDDSN
EEENKDSLVDDEEEKEDLGDEDEAEEEEEDNLAAGVDEERSEANDQGPPGEDGVTREEVEPE
EAEEGISEQPCPADTEVVEDSLRQRKSQHADKGL

Important features:

Signal peptide:
amino acids 1-22

Transmembrane domain:
amino acids 191-211

N-glycosylation site.
amino acids 46-49

Thioredoxin family proteins.   (homologous region to disulfide isomerase)
amino acids 56-72

Flavodoxin proteins
amino acids 173-187

FIGURE 425

```
GAGGAACCTACCGGTACCGGCCGCGCGCTGGTAGTCGCCGGTGTGGCTGCACCTCACCAATCCCGTGCGCCGCGG
CTGGGCCGTCGGAGAGTGCGTGTGCTTCTCTCCTGCACGCGGTGCTTGGGCTCGGCCAGGCGGGGTCCGCCGCCA
GGGTTTGAGGATGGGGGAGTAGCTACAGGAAGCGACCCCGCGATGGCAAGGTATATTTTTGTGGAATGAAAAGGA
AGTATTAGAAATGAGCTGAAGACCATTCACAGATTAATATTTTTGGGGACAGATTTGTGATGCTTGATTCACCCT
TGAAGTAATGTAGACAGAAGTTCTCAAATTTGCATATTACATCAACTGGAACCAGCAGTGAATCTAATGTTCAC
TTAAATCAGAACTTGCATAAGAAAGAGAATGGGAGTCTGGTTAAATAAAGATGACTATATCAGAGACTTGAAAAG
GATCATTCTCTGTTTTCTGATAGTGTATATGGCCATTTTAGTGGGCACAGATCAGGATTTTTACAGTTTACTTGG
AGTGTCCAAAACTGCAAGCAGTAGAGAAATAAGACAAGCTTTCAAGAAATTGGCATTGAAGTTACATCCTGATAA
AAACCCGAATAACCCAAATGCACATGGCGATTTTTTAAAAATAAATAGAGCATATGAAGTACTCAAAGATGAAGA
TCTACGGAAAAAGTATGACAAATATGGAGAAAAGGGACTTGAGGATAATCAAGGTGGCCAGTATGAAAGCTGGAA
CTATTATCGTTATGATTTTGGTATTTATGATGATGATCCTGAAATCATAACATTGGAAAGAAGAGAATTTGATGC
TGCTGTTAATTCTGGAGAACTGTGGTTTGTAAATTTTTACTCCCCAGGCTGTTCACACTGCCATGATTTAGCTCC
CACATGGAGAGACTTTGCTAAAGAAGTGGATGGGTTACTTCGAATTGGAGCTGTTAACTGTGGTGATGATAGAAT
GCTTTGCCGAATGAAAGGAGTCAACAGCTATCCCAGTCTCTTCATTTTTCGGTCTGGAATGGCCCCAGTGAAATA
TCATGGAGACAGATCAAAGGAGAGTTTAGTGAGTTTTGCAATGCAGCATGTTAGAAGTACAGTGACAGAACTTTG
GACAGGAAATTTTGTCAACTCCATACAAACTGCTTTTGCTGCTGGTATTGGCTGGCTGATCACTTTTTGTTCAAA
AGGAGGAGATTGTTTGACTTCACAGACACGACTCAGGCTTAGTGGCATGTTGTTTCTCAACTCATTGGATGCTAA
AGAAATATATTTGGAAGTAATACATAATCTTCCAGATTTTGAACTACTTTCGGCAAACACACTAGAGGATCGTTT
GGCTCATCATCGGTGGCTGTTATTTTTTCATTTTGGAAAAAATGAAAATTCAAATGATCCTGAGCTGAAAAAACT
AAAAACTCTACTTAAAAATGATCATATTCAAGTTGGCAGGTTTGACTGTTCCTCTGCACCAGACATCTGTAGTAA
TCTGTATGTTTTTCAGCCGTCTCTAGCAGTATTTAAAGGACAAGGAACCAAAGAATATGAAATTCATCATGGAAA
GAAGATTCTATATGATATACTTGCCTTTGCCAAAGAAAGTGTGAATTCTCATGTTACCACGCTTGGACCTCAAAA
TTTTCCTGCCAATGACAAAGAACCATGGCTTGTTGATTTCTTTGCCCCCTGGTGTCCACCATGTCGAGCTTTACT
ACCAGAGTTACGAAGAGCATCAAATCTTCTTTATGGTCAGCTTAAGTTTGGTACACTAGATTGTACAGTTCATGA
GGGACTCTGTAACATGTATAACATTCAGGCTTATCCAACAACAGTGGTATTCAACCAGTCCAACATTCATGAGTA
TGAAGGACATCACTCTGCTGAACAAATCTTGGAGTTCATAGAGGATCTTATGAATCCTTCAGTGGTCTCCCTTAC
ACCCACCACCTTCAACGAACTAGTTACACAAAGAAAACACAACGAAGTCTGGATGGTTGATTTCTATTCTCCGTG
GTGTCATCCTTGCCAAGTCTTAATGCCAGAATGGAAAAGAATGGCCCGGACATTAACTGGACTGATCAACGTGGG
CAGTATAGATTGCCAACAGTATCATTCTTTTTGTGCCCAGGAAAACGTTCAAAGATACCCTGAGATAAGATTTTT
TCCCCCAAAATCAAATAAAGCTTATCAGTATCACAGTTACAATGGTTGGAATAGGGATGCTTATTCCCTGAGAAT
CTGGGGTCTAGGATTTTTACCTCAAGTATCCACAGATCTAACACCTCAGACTTTCAGTGAAAAAGTTCTACAAGG
GAAAAATCATTGGGTGATTGATTTCTATGCTCCTTGGTGTGGACCTTGCCAGAATTTTGCTCCAGAATTTGAGCT
CTTGGCTAGGATGATTAAAGGAAAAGTGAAAGCTGGAAAAGTAGACTGTCAGGCTTATGCTCAGACATGCCAGAA
AGCTGGGATCAGGGCCTATCCAACTGTTAAGTTTTATTTCTACGAAAGAGCAAAGAGAAATTTTCAAGAAGAGCA
GATAAATACCAGAGATGCAAAAGCAATCGCTGCCTTAATAAGTGAAAAATTGGAAACTCTCCGAAATCAAGGCAA
GAGGAATAAGGATGAACTTTGATAATGTTGAAGATGAAGAAAAAGTTTAAAAGAAATTCTGACAGATGACATCAG
AAGACACCTATTTAGAATGTTACATTTATGATGGGAATGAATGAACATTATCTTAGACTTGCAGTTGTACTGCCA
GAATTATCTACAGCACTGGTGTAAAAGAAGGGTCTGCAAACTTTTTCTGTAAAGGGCCGGTTTATAAATATTTTA
GACTTTGCAGGCTATAATATATGGTTCACACATGAGAACAAGAATAGAGTCATCATGTATTCTTTGTTATTTGCT
TTTAACAACCTTTAAAAAAATATTAAAACGATTCTTAGCTCAGAGCCATACAAAAGTAGGCTGGATTCAGTCCATG
GACCATAGATTGCTGTCCCCTCGACGGACTTATAATGTTTCAGGTGGCTGGCTTGAACATGAGTCTGCTGTGCT
ATCTACATAAATGTCTAAGTTGTATAAAGTCCACTTTCCCTTCACGTTTTTTGGCTGACCTGAAAAGAGGTAACT
TAGTTTTTGGTCACTTGTTCTCCTAAAAATGCTATCCCTAACCATATATTTATATTTCGTTTTAAAAACACCCAT
GATGTGGCACAGTAAACAAACCCTGTTATGCTGTATTATTATGAGGAGATTCTTCATTGTTTCTTTCCTTCTCA
AAGGTTGAAAAAATGCTTTAATTTTTCACAGCCGAGAAACAGTGCAGCAGTATATGTGCACACAGTAAGTACAC
AAATTTGAGCAACAGTAAGTGCACAAATTCTGTAGTTTGCTGTATCATCCAGGAAAACCTGAGGGAAAAAAATTA
TAGCAATTAACTGGGCATTGTAGAGTATCCTAAATATGTTATCAAGTATTTAGAGTTCTATATTTTAAAGATATA
TGTGTTCATGTATTTTCTGAAATTGCTTTCATAGAAATTTTCCCACTGATAGTTGATTTTTGAGGCATCTAATAT
TTACATATTTGCCTTCTGAACTTTGTTTTGACCTGTATCCTTTATTTACATTGGGTTTTCTTTCATAGTTTTGG
TTTTTCACTCCTGTCCAGTCTATTTATTATTCAAATAGGAAAATTACTTTACAGGTTGTTTACTGTAGCTTAT
AATGATACTGTAGTTATTCCAGTTACTAGTTTACTGTCAGAGGGCTGCCTTTTCAGATAAATATTGACATAATA
ACTGAAGTTATTTTTATAAGAAAATCAAGTATATAAATCTAGGAAAGGGATCTTCTAGTTTCTGTGTTGTTTAGA
CTCAAAGAATCACAAATTTGTCAGTAACATGTAGTTGTTTAGTTATAATTCAGAGTGTACAGAATGGTAAAAATT
CCAATCAGTCAAAAGAGGTCAATGAATTAAAAGGCTTGCAACTTTTTCAAAAAAAAAAAAAAAAA
```

FIGURE 426

MGVWLNKDDYIRDLKRIILCFLIVYMAILVGTDQDFYSLLGVSKTASSREIRQAFKKLALKLH
PDKNPNNPNAHGDFLKINRAYEVLKDEDLRKKYDKYGEKGLEDNQGGQYESWNYYRYDFGIYD
DDPEIITLERREFDAAVNSGELWFVNFYSPGCSHCHDLAPTWRDFAKEVDGLLRIGAVNCGDD
RMLCRMKGVNSYPSLFIFRSGMAPVKYHGDRSKESLVSFAMQHVRSTVTELWTGNFVNSIQTA
FAAGIGWLITFCSKGGDCLTSQTRLRLSGMLFLNSLDAKEIYLEVIHNLPDFELLSANTLEDR
LAHHRWLLFFHFGKNENSNDPELKKLKTLLKNDHIQVGRFDCSSAPDICSNLYVFQPSLAVFK
GQGTKEYEIHHGKKILYDILAFAKESVNSHVTTLGPQNFPANDKEPWLVDFFAPWCPPCRALL
PELRRASNLLYGQLKFGTLDCTVHEGLCNMYNIQAYPTTVVFNQSNIHEYEGHHSAEQILEFI
EDLMNPSVVSLTPTTFNELVTQRKHNEVWMVDFYSPWCHPCQVLMPEWKRMARTLTGLINVGS
IDCQQYHSFCAQENVQRYPEIRFFPPKSNKAYQYHSYNGWNRDAYSLRIWGLGFLPQVSTDLT
PQTFSEKVLQGKNHWVIDFYAPWCGPCQNFAPEFELLARMIKGKVKAGKVDCQAYAQTCQKAG
IRAYPTVKFYFYERAKRNFQEEQINTRDAKAIAALISEKLETLRNQGKRNKDEL

Important features:

Endoplasmic reticulum targeting sequence.
amino acids 744-747

Cytochrome c family heme-binding site signature.
amino acids 158-163

Nt-dnaJ domain signature.
amino acids 77-96

N-glycosylation site.
amino acids 484-487

FIGURE 427

CTGCAGTCAGGACTCTGGGACCGCAGGGGGCTCCCGGACCCTGACTCTGCAGCCGAACCGGCA
CGGTTTCGTGGGGACCCAGGCTTGCAAAGTGACGGTCATTTTCTCTTTCTTTCTCCCTCTTGA
GTCCTTCTGAG<u>ATG</u>ATGGCTCTGGGCGCAGCGGGAGCTACCCGGGTCTTTGTCGCGATGGTAG
CGGCGGCTCTCGGCGGCCACCCTCTGCTGGGAGTGAGCGCCACCTTGAACTCGGTTCTCAATT
CCAACGCTATCAAGAACCTGCCCCACCGCTGGGCGGCGCTGCGGGCACCCAGGCTCTGCAG
TCAGCGCCGCGCCGGGAATCCTGTACCCGGGCGGGAATAAGTACCAGACCATTGACAACTACC
AGCCGTACCCGTGCGCAGAGGACGAGGAGTGCGGCACTGATGAGTACTGCGCTAGTCCCACCC
GCGGAGGGGACGCAGGCGTGCAAATCTGTCTCGCCTGCAGGAAGCGCCGAAAACGCTGCATGC
GTCACGCTATGTGCTGCCCCGGGAATTACTGCAAAAATGGAATATGTGTGTCTTCTGATCAAA
ATCATTTCCGAGGAGAAATTGAGGAAACCATCACTGAAAGCTTTGGTAATGATCATAGCACCT
TGGATGGGTATTCCAGAAGAACCACCTTGTCTTCAAAAATGTATCACACCAAAGGACAAGAAG
GTTCTGTTTGTCTCCGGTCATCAGACTGTGCCTCAGGATTGTGTTGTGCTAGACACTTCTGGT
CCAAGATCTGTAAACCTGTCCTGAAAGAAGGTCAAGTGTGTACCAAGCATAGGAGAAAAGGCT
CTCATGGACTAGAAATATTCCAGCGTTGTTACTGTGGAGAAGGTCTGTCTTGCCGGATACAGA
AAGATCACCATCAAGCCAGTAATTCTTCTAGGCTTCACACTTGTCAGAGACAC<u>TAA</u>ACCAGCT
ATCCAAATGCAGTGAACTCCTTTTATATAATAGATGCTATGAAAACCTTTTATGACCTTCATC
AACTCAATCCTAAGGATATACAAGTTCTGTGGTTTCAGTTAAGCATTCCAATAACACCTTCCA
AAAACCTGGAGTGTAAGAGCTTTGTTTCTTTATGGAACTCCCCTGTGATTGCAGTAAATTACT
GTATTGTAAATTCTCAGTGTGGCACTTACCTGTAAATGCAATGAAACTTTTAATTATTTTCT
AAAGGTGCTGCACTGCCTATTTTCCTCTTGTTATGTAAATTTTGTACACATTGATTGTTAT
CTTGACTGACAAATATTCTATATTGAACTGAAGTAAATCATTTCAGCTTATAGTTCTTAAAAG
CATAACCCTTTACCCCATTTAATTCTAGAGTCTAGAACGCAAGGATCTCTTGGAATGACAAAT
GATAGGTACCTAAAATGTAACATGAAAATACTAGCTTATTTTCTGAAATGTACTATCTTAATG
CTTAAATTATATTTCCCTTTAGGCTGTGATAGTTTTGAAATAAATTTAACATTTAAAAAAA
AAAAAA

FIGURE 428

MMALGAAGATRVFVAMVAAALGGHPLLGVSATLNSVLNSNAIKNLPPPLGGAAGHPGSAVSAA
PGILYPGGNKYQTIDNYQPYPCAEDEECGTDEYCASPTRGGDAGVQICLACRKRRKRCMRHAM
CCPGNYCKNGICVSSDQNHFRGEIEETITESFGNDHSTLDGYSRRTTLSSKMYHTKGQEGSVC
LRSSDCASGLCCARHFWSKICKPVLKEGQVCTKHRRKGSHGLEIFQRCYCGEGLSCRIQKDHH
QASNSSRLHTCQRH

Important features:
Signal peptide:
amino acids 1-23

N-glycosylation site.
amino acids 256-259

Fungal Zn(2)-Cys(6) binuclear cluster domain
amino acids 110-126

FIGURE 429

```
GAGAGGACGAGGTGCCGCTGCCTGGAGAATCCTCCGCTGCCGTCGGCTCCCGGAGCCCAGCCC
TTTCCTAACCCAACCCAACCTAGCCCAGTCCCAGCCGCCAGCGCCTGTCCCTGTCACGGACCC
CAGCGTTACCATGCATCCTGCCGTCTTCCTATCCTTACCCGACCTCAGATGCTCCCTTCTGCT
CCTGGTAACTTGGGTTTTTACTCCTGTAACAACTGAAATAACAAGTCTTGCTACAGAGAATAT
AGATGAAATTTTAAACAATGCTGATGTTGCTTTAGTAAATTTTTATGCTGACTGGTGTCGTTT
CAGTCAGATGTTGCATCCAATTTTTGAGGAAGCTTCCGATGTCATTAAGGAAGAATTTCCAAA
TGAAAATCAAGTAGTGTTTGCCAGAGTTGATTGTGATCAGCACTCTGACATAGCCCAGAGATA
CAGGATAAGCAAATACCCAACCCTCAAATTGTTTCGTAATGGGATGATGATGAAGAGAGAATA
CAGGGGTCAGCGATCAGTGAAAGCATTGGCAGATTACATCAGGCAACAAAAAGTGACCCCAT
TCAAGAAATTCGGGACTTAGCAGAAATCACCACTCTTGATCGCAGCAAAAGAAATATCATTGG
ATATTTGAGCAAAAGGACTCGGACAACTATAGAGTTTTTGAACGAGTAGCGAATATTTTGCA
TGATGACTGTGCCTTTCTTTCTGCATTTGGGGATGTTTCAAAACCGGAAAGATATAGTGGCGA
CAACATAATCTACAAACCACCAGGGCATTCTGCTCCGGATATGGTGTACTTGGGAGCTATGAC
AAATTTTGATGTGACTTACAATTGGATTCAAGATAAATGTGTTCCTCTTGTCCGAGAAATAAC
ATTTGAAAATGGAGAGGAATTGACAGAAGAAGGACTGCCTTTTCTCATACTCTTTCACATGAA
AGAAGATACAGAAAGTTTAGAAATATTCCAGAATGAAGTAGCTCGGCAATTAATAAGTGAAAA
AGGTACAATAAACTTTTTACATGCCGATTGTGACAAATTTAGACATCCTCTTCTGCACATACA
GAAAACTCCAGCAGATTGTCCTGTAATCGCTATTGACAGCTTTAGGCATATGTATGTGTTTGG
AGACTTCAAAGATGTATTAATTCCTGGAAAACTCAAGCAATTCGTATTTGACTTACATTCTGG
AAAACTGCACAGAGAATTCCATCATGGACCTGACCCAACTGATACAGCCCCAGGAGAGCAAGC
CCAAGATGTAGCAAGCAGTCCACCTGAGAGCTCCTTCCAGAAACTAGCACCCAGTGAATATAG
GTATACTCTATTGAGGGATCGAGATGAGCTTTAAAAACTTGAAAAACAGTTTGTAAGCCTTTC
AACAGCAGCATCAACCTACGTGGTGGAAATAGTAAACCTATATTTTCATAATTCTATGTGTAT
TTTTATTTTGAATAAACAGAAGAAATTTAAAAAAAAAAAAAAAAAAAAAAAAAAAAAAAAA
AAAAAAAAAA
```

FIGURE 430

MHPAVFLSLPDLRCSLLLLVTWVFTPVTTEITSLATENIDEILNNADVALVNFYADWCRFSQM
LHPIFEEASDVIKEEFPNENQVVFARVDCDQHSDIAQRYRISKYPTLKLFRNGMMMKREYRGQ
RSVKALADYIRQQKSDPIQEIRDLAEITTLDRSKRNIIGYFEQKDSDNYRVFERVANILHDDC
AFLSAFGDVSKPERYSGDNIIYKPPGHSAPDMVYLGAMTNFDVTYNWIQDKCVPLVREITFEN
GEELTEEGLPFLILFHMKEDTESLEIFQNEVARQLISEKGTINFLHADCDKFRHPLLHIQKTP
ADCPVIAIDSFRHMYVFGDFKDVLIPGKLKQFVFDLHSGKLHREFHHGPDPTDTAPGEQAQDV
ASSPPESSFQKLAPSEYRYTLLRDRDEL

Important features:
Signal peptide:
amino acids 1-29

Endoplasmic reticulum targeting sequence.
amino acids 403-406

Tyrosine kinase phosphorylation site.
amino acids 203-211

Thioredoxin family proteins
amino acids 50-66

FIGURE 431

GAGCAGGACGGAGCC<u>ATG</u>GACCCCGCCAGGAAAGCAGGTGCCCAGGCCATGATCTGGACTGCA
GGCTGGCTGCTGCTGCTGCTTCGCGGAGGAGCGCAGGCCCTGGAGTGCTACAGCTGCGTG
CAGAAAGCAGATGACGGATGCTCCCCGAACAAGATGAAGACAGTGAAGTGCGCGCCGGGCGTG
GACGTCTGCACCGAGGCCGTGGGGGCGGTGGAGACCATCCACGGACAATTCTCGCTGGCAGTG
CGGGGTTGCGGTTCGGGACTCCCCGGCAAGAATGACCGCGGCCTGGATCTTCACGGGCTTCTG
GCGTTCATCCAGCTGCAGCAATGCGCTCAGGATCGCTGCAACGCCAAGCTCAACCTCACCTCG
CGGGCGCTCGACCCGGCAGGTAATGAGAGTGCATACCCGCCCAACGGCGTGGAGTGCTACAGC
TGTGTGGGCCTGAGCCGGGAGGCGTGCCAGGGTACATCGCCGCCGGTCGTGAGCTGCTACAAC
GCCAGCGATCATGTCTACAAGGGCTGCTTCGACGGCAACGTCACCTTGACGGCAGCTAATGTG
ACTGTGTCCTTGCCTGTCCGGGGCTGTGTCCAGGATGAATTCTGCACTCGGGATGGAGTAACA
GGCCCAGGGTTCACGCTCAGTGGCTCCTGTTGCCAGGGGTCCCGCTGTAACTCTGACCTCCGC
AACAAGACCTACTTCTCCCCTCGAATCCCACCCCTTGTCCGGCTGCCCCCTCCAGAGCCCACG
ACTGTGGCCTCAACCACATCTGTCACCACTTCTACCTCGGCCCCAGTGAGACCCACATCCACC
ACCAAACCCATGCCAGCGCCAACCAGTCAGACTCCGAGACAGGGAGTAGAACACGAGGCCTCC
CGGGATGAGGAGCCCAGGTTGACTGGAGGCGCCGCTGGCCACCAGGACCGCAGCAATTCAGGG
CAGTATCCTGCAAAAGGGGGCCCCAGCAGCCCCATAATAAAGGCTGTGTGGCTCCCACAGCT
GGATTGGCAGCCCTTCTGTTGGCCGTGGCTGCTGGTGTCCTACTG<u>TGA</u>GCTTCTCCACCTGGA
AATTTCCCTCTCACCTACTTCTCTGGCCCTGGGTACCCCTCTTCTCATCACTTCCTGTTCCCA
CCACTGGACTGGGCTGGCCCAGCCCCTGTTTTTCCAACATTCCCCAGTATCCCCAGCTTCTGC
TGCGCTGGTTTGCGGCTTTGGGAAATAAAATACCGTTGTATATATTCTGCCAGGGGTGTTCTA
GCTTTTTGAGGACAGCTCCTGTATCCTTCTCATCCTTGTCTCTCCGCTTGTCCTCTTGTGATG
TTAGGACAGAGTGAGAGAAGTCAGCTGTCACGGGGAAGGTGAGAGAGAGGATGCTAAGCTTCC
TACTCACTTTCTCCTAGCCAGCCTGGACTTTGGAGCGTGGGGTGGGTGGGACAATGGCTCCCC
ACTCTAAGCACTGCCTCCCCTACTCCCCGCATCTTTGGGGAATCGGTTCCCCATATGTCTTCC
TTACTAGACTGTGAGCTCCTCGAGGGGGGCCCGGTACCCAATTCGCCCTATAGTGAGTCGTA

FIGURE 432

MDPARKAGAQAMIWTAGWLLLLLLRGGAQALECYSCVQKADDGCSPNKMKTVKCAPGVDVCTE

AVGAVETIHGQFSLAVRGCGSGLPGKNDRGLDLHGLLAFIQLQQCAQDRCNAKLNLTSRALDP

AGNESAYPPNGVECYSCVGLSREACQGTSPPVVSCYNASDHVYKGCFDGNVTLTAANVTVSLP

VRGCVQDEFCTRDGVTGPGFTLSGSCCQGSRCNSDLRNKTYFSPRIPPLVRLPPPEPTTVAST

TSVTTSTSAPVRPTSTTKPMPAPTSQTPRQGVEHEASRDEEPRLTGGAAGHQDRSNSGQYPAK

GGPQQPHNKGCVAPTAGLAALLLAVAAGVLL

FIGURE 433

CGGGACTCGGCGGGTCCTCCTGGGAGTCTCGGAGGGGACCGGCTGTGCAGACGCCATGGAGTT
GGTGCTGGTCTTCCTCTGCAGCCTGCTGGCCCCATGGTCCTGGCCAGTGCAGCTGAAAAGGA
GAAGGAAATGGACCCTTTTCATTATGATTACCAGACCCTGAGGATTGGGGGACTGGTGTTCGC
TGTGGTCCTCTTCTCGGTTGGGATCCTCCTTATCCTAAGTCGCAGGTGCAAGTGCAGTTTCAA
TCAGAAGCCCCGGGCCCCAGGAGATGAGGAAGCCCAGGTGGAGAACCTCATCACCGCCAATGC
AACAGAGCCCCAGAAGCAGAGAACTGAAGTGCAGCCATCAGGTGGAAGCCTCTGGAACCTGAG
GCGGCTGCTTGAACCTTTGGATGCAAATGTCGATGCTTAAGAAAACCGGCCACTTCAGCAACA
GCCCTTTCCCCAGGAGAAGCCAAGAACTTGTGTGTCCCCCACCCTATCCCCTCTAACACCATT
CCTCCACCTGATGATGCAACTAACACTTGCCTCCCCACTGCAGCCTGCGGTCCTGCCCACCTC
CCGTGATGTGTGTGTGTGTGTGTGTGTGTGACTGTGTGTGTTTGCTAACTGTGGTCTTTGTGG
CTACTTGTTTGTGGATGGTATTGTGTTTGTTAGTGAACTGTGGACTCGCTTTCCCAGGCAGGG
GCTGAGCCACATGGCCATCTGCTCCTCCCTGCCCCGTGGCCCTCCATCACCTTCTGCTCCTA
GGAGGCTGCTTGTTGCCCGAGACCAGCCCCCTCCCTGATTTAGGGATGCGTAGGGTAAGAGC
ACGGGCAGTGGTCTTCAGTCGTCTTGGGACCTGGGAAGGTTTGCAGCACTTTGTCATCATTCT
TCATGGACTCCTTTCACTCCTTTAACAAAAACCTTGCTTCCTTATCCCACCTGATCCCAGTCT
GAAGGTCTCTTAGCAACTGGAGATACAAAGCAAGGAGCTGGTGAGCCCAGCGTTGACGTCAGG
CAGGCTATGCCCTTCCGTGGTTAATTTCTTCCCAGGGGCTTCCACGAGGAGTCCCCATCTGCC
CCGCCCCTTCACAGAGCGCCCGGGGATTCCAGGCCCAGGGCTTCTACTCTGCCCCTGGGGAAT
GTGTCCCCTGCATATCTTCTCAGCAATAACTCCATGGGCTCTGGGACCCTACCCCTTCCAACC
TTCCCTGCTTCTGAGACTTCAATCTACAGCCCAGCTCATCCAGATGCAGACTACAGTCCCTGC
AATTGGGTCTCTGGCAGGCAATAGTTGAAGGACTCCTGTTCCGTTGGGGCCAGCACACCGGGA
TGGATGGAGGGAGAGCAGAGGCCTTTGCTTCTCTGCCTACGTCCCCTTAGATGGGCAGCAGAG
GCAACTCCCGCATCCTTTGCTCTGCCTGTCGGTGGTCAGAGCGGTGAGCGAGGTGGGTTGGAG
ACTCAGCAGGCTCCGTGCAGCCCTTGGGAACAGTGAGAGGTTGAAGGTCATAACGAGAGTGGG
AACTCAACCCAGATCCCGCCCCTCCTGTCCTCTGTGTTCCCGCGGAAACCAACCAAACCGTGC
GCTGTGACCCATTGCTGTTCTCTGTATCGTGATCTATCCTCAACAACAACAGAAAAAAGGAAT
AAAATATCCTTTGTTTCCT

FIGURE 434

MELVLVFLCSLLAPMVLASAAEKEKEMDPFHYDYQTLRIGGLVFAVVLFSVGILLILSRRCKC
SFNQKPRAPGDEEAQVENLITANATEPQKQRTEVQPSGGSLWNLRRLLEPLDANVDA

FIGURE 435

```
GGTCCTTAATGGCAGCAGCCGCCGCTACCAAGATCCTTCTGTGCCTCCCGCTTCTGCTCCTGC
TGTCCGGCTGGTCCCGGGCTGGGCGAGCCGACCCTCACTCTCTTTGCTATGACATCACCGTCA
TCCCTAAGTTCAGACCTGGACCACGGTGGTGTGCGGTTCAAGGCCAGGTGGATGAAAAGACTT
TTCTTCACTATGACTGTGGCAACAAGACAGTCACACCTGTCAGTCCCTGGGGAAGAAACTAA
ATGTCACAACGGCCTGGAAAGCACAGAACCCAGTACTGAGAGAGGTGGTGGACATACTTACAG
AGCAACTGCGTGACATTCAGCTGGAGAATTACACACCCAAGGAACCCCTCACCCTGCAGGCAA
GGATGTCTTGTGAGCAGAAAGCTGAAGGACACAGCAGTGGATCTTGGCAGTTCAGTTTCGATG
GGCAGATCTTCCTCCTCTTTGACTCAGAGAAGAGAATGTGGACAACGGTTCATCCTGGAGCCA
GAAAGATGAAAGAAAGTGGGAGAATGACAAGGTTGTGGCCATGTCCTTCCATTACTTCTCAA
TGGGAGACTGTATAGGATGGCTTGAGGACTTCTTGATGGGCATGGACAGCACCCTGGAGCCAA
GTGCAGGAGCACCACTCGCCATGTCCTCAGGCACAACCCAACTCAGGGCCACAGCCACCACCC
TCATCCTTTGCTGCCTCCTCATCATCCTCCCCTGCTTCATCCTCCCTGGCATCTGAGGAGAGT
CCTTTAGAGTGACAGGTTAAAGCTGATACCAAAAGGCTCCTGTGAGCACGGTCTTGATCAAAC
TCGCCCTTCTGTCTGGCCAGCTGCCCACGACCTACGGTGTATGTCCAGTGGCCTCCAGCAGAT
CATGATGACATCATGGACCCAATAGCTCATTCACTGCCTTGATTCCTTTTGCCAACAATTTTA
CCAGCAGTTATACCTAACATATTATGCAATTTTCTCTTGGTGCTACCTGATGGAATTCCTGCA
CTTAAAGTTCTGGCTGACTAAACAAGATATATCATTTTCTTTCTTCTTTTTGTTTGGAAAA
TCAAGTACTTCTTTGAATGATGATCTCTTTCTTGCAAATGATATTGTCAGTAAAATAATCACG
TTAGACTTCAGACCTCTGGGGATTCTTTCCGTGTCCTGAAAGAGAATTTTTAAATTATTTAAT
AAGAAAAAATTTATATTAATGATTGTTTCCTTTAGTAATTTATTGTTCTGTACTGATATTTAA
ATAAAGAGTTCTATTTCCAAAAAAAAAAAAAAAAAA
```

FIGURE 436

MAAAAATKILLCLPLLLLLSGWSRAGRADPHSLCYDITVIPKFRPGPRWCAVQGQVDEKTFLH
YDCGNKTVTPVSPLGKKLNVTTAWKAQNPVLREVVDILTEQLRDIQLENYTPKEPLTLQARMS
CEQKAEGHSSGSWQFSFDGQIFLLFDSEKRMWTTVHPGARKMKEKWENDKVVAMSFHYFSMGD
CIGWLEDFLMGMDSTLEPSAGAPLAMSSGTTQLRATATTLILCCLLIILPCFILPGI

FIGURE 437

```
GTTCTCCTTTCCGAGCCAAAATCCCAGGCGATGGTGAATTATGAACGTGCCACACCATGAAGCTCTTGTGGCAGG
TAACTGTGCACCACCACACCTGGAATGCCATCCTGCTCCCGTTCGTCTACCTCACGGCGCAAGTGTGGATTCTGT
GTGCAGCCATCGCTGCTGCCGCCTCAGCCGGGCCCCAGAACTGCCCCTCCGTTTGCTCGTGCAGTAACCAGTTCA
GCAAGGTGGTGTGCACGCGCCGGGGCCTCTCCGAGGTCCCGCAGGGTATTCCCTCGAACACCCGGTACCTCAACC
TCATGGAGAACAACATCCAGATGATCCAGGCCGACACCTTCCGCCACCTCCACCACCTGGAGGTCCTGCAGTTGG
GCAGGAACTCCATCCGGCAGATTGAGGTGGGGGCCTTCAACGGCCTGGCCAGCCTCAACACCCTGGAGCTGTTCG
ACAACTGGCTGACAGTCATCCCTAGCGGGGCCTTTGAATACCTGTCCAAGCTGCGGGAGCTCTGGCTTCGCAACA
ACCCCATCGAAAGCATCCCCTCTTACGCCTTCAACCGGGTGCCCTCCCTCATGCGCCTGGACTTGGGGGAGCTCA
AGAAGCTGGAGTATATCTCTGAGGGAGCTTTTGAGGGGCTGTTCAACCTCAAGTATCTGAACTTGGGCATGTGCA
ACATTAAAGACATGCCCAATCTCACCCCCCTGGTGGGGCTGGAGGAGCTGGAGATGTCAGGGAACCACTTCCCTG
AGATCAGGCCTGGCTCCTTCCATGGCCTGAGCTCCCTCAAGAAGCTCTGGGTCATGAACTCACAGGTCAGCCTGA
TTGAGCGGAATGCTTTTGACGGGCTGGCTTCACTTGTGGAACTCAACTTGGCCCACAATAACCTCTCTTCTTTGC
CCCATGACCTCTTTACCCCGCTGAGGTACCTGGTGGAGTTGCATCTACACCACAACCCTTGGAACTGTGATTGTG
ACATTCTGTGGCTAGCCTGGTGGCTTCGAGAGTATATACCCACCAATTCCACCTGCTGTGGCCGCTGTCATGCTC
CCATGCACATGCGAGGCCGCTACCTCGTGGAGGTGGACCAGGCCTCCTTCCAGTGCTCTGCCCCTTCATCATGG
ACGCACCTCGAGACCTCAACATTTCTGAGGGTCGGATGGCAGAACTTAAGTGTCGGACTCCCCTATGTCCTCCG
TGAAGTGGTTGCTGCCCAATGGGACAGTGCTCAGCCACGCCTCCCGCCACCCAAGGATCTCTGTCCTCAACGACG
GCACCTTGAACTTTTCCCACGTGCTGCTTTCAGACACTGGGGTGTACACATGCATGGTGACCAATGTTGCAGGCA
ACTCCAACGCCTCGGCCTACCTCAATGTGAGCACGGCTGAGCTTAACACCTCCAACTACAGCTTCTTCACCACAG
TAACAGTGGAGACCACGGAGATCTCGCCTGAGGACACAACGCGAAAGTACAAGCCTGTTCCTACCACGTCCACTG
GTTACCAGCCGGCATATACCACCTCTACCACGGTGCTCATTCAGACTACCCGTGTGCCCAAGCAGGTGGCAGTAC
CCGCGACAGACACCACTGACAAGATGCAGACCAGCCTGGATGAAGTCATGAAGACCACCAAGATCATCATTGGCT
GCTTTGTGGCAGTGACTCTGCTAGCTGCCGCCATGTTGATTGTCTTCTATAAACTTCGTAAGCGGCACCAGCAGC
GGAGTACAGTCACAGCCGCCCGGACTGTTGAGATAATCCAGGTGGACGAAGACATCCCAGCAGCAACATCCGCAG
CAGCAACAGCAGCTCCGTCCGGTGTATCAGGTGAGGGGCAGTAGTGCTGCCCACAATTCATGACCATATTAACT
ACAACACCTACAAACCAGCACATGGGCCCACTGGACAGAAAACAGCCTGGGGAACTCTCTGCACCCCACAGTCA
CCACTATCTCTGAACCTTATATAATTCAGACCCATACCAAGGACAAGGTACAGGAAACTCAAATATGACTCCCCT
CCCCCAAAAAACTTATAAAATGCAATAGAATGCACACAAAGACAGCAACTTTTGTACAGAGTGGGGAGAGACTTT
TTCTTGTATATGCTTATATATTAAGTCTATGGGCTGGTTAAAAAAAACAGATTATATTAAAATTTAAAGACAAAA
AGTCAAAACA
```

FIGURE 438

MKLLWQVTVHHHTWNAILLPFVYLTAQVWILCAAIAAAASAGPQNCPSVCSCSNQFSKVVCTR
RGLSEVPQGIPSNTRYLNLMENNIQMIQADTFRHLHHLEVLQLGRNSIRQIEVGAFNGLASLN
TLELFDNWLTVIPSGAFEYLSKLRELWLRNNPIESIPSYAFNRVPSLMRLDLGELKKLEYISE
GAFEGLFNLKYLNLGMCNIKDMPNLTPLVGLEELEMSGNHFPEIRPGSFHGLSSLKKLWVMNS
QVSLIERNAFDGLASLVELNLAHNNLSSLPHDLFTPLRYLVELHLHHNPWNCDCDILWLAWWL
REYIPTNSTCCGRCHAPMHMRGRYLVEVDQASFQCSAPFIMDAPRDLNISEGRMAELKCRTPP
MSSVKWLLPNGTVLSHASRHPRISVLNDGTLNFSHVLLSDTGVYTCMVTNVAGNSNASAYLNV
STAELNTSNYSFFTTVTVETTEISPEDTTRKYKPVPTTSTGYQPAYTTSTTVLIQTTRVPKQV
AVPATDTTDKMQTSLDEVMKTTKIIIGCFVAVTLLAAAMLIVFYKLRKRHQQRSTVTAARTVE
IIQVDEDIPAATSAAATAAPSGVSGEGAVVLPTIHDHINYNTYKPAHGAHWTENSLGNSLHPT
VTTISEPYIIQTHTKDKVQETQI

FIGURE 439

GTCGAATCCAAATCACTCATTGTGAAAGCTGAGCTCACAGCCGAATAAGCCACCATGAGGCTG
TCAGTGTGTCTCCTGATGGTCTCGCTGGCCCTTTGCTGCTACCAGGCCCATGCTCTTGTCTGC
CCAGCTGTTGCTTCTGAGATCACAGTCTTCTTATTCTTAAGTGACGCTGCGGTAAACCTCCAA
GTTGCCAAACTTAATCCACCTCCAGAAGCTCTTGCAGCCAAGTTGGAAGTGAAGCACTGCACC
GATCAGATATCTTTTAAGAAACGACTCTCATTGAAAAGTCCTGGTGGAAATAGTGAAAAAAT
GTGGTGTGTGACATGTAAAAATGCTCAACCTGGTTTCCAAAGTCTTTCAACGACACCCTGATC
TTCACTAAAAATTGTAAAGGTTTCAACACGTTGCTTTAATAAATCACTTGCCCTGC

FIGURE 440

MRLSVCLLMVSLALCCYQAHALVCPAVASEITVFLFLSDAAVNLQVAKLNPPPEALAAKLEVK
HCTDQISFKKRLSLKKSWWK

FIGURE 441

GAACATTTTTAGTTCCCAAGGAATGTACATCAGCCCCACGGAAGCTAGGCCACCTCTGGGATG
GGGTTGCTGGTTTAAAACAAACGCCAGTCATCCTATATAAGGACCTGACAGCCACCAGGCACC
ACCTCCGCCAGGAACTGCAGGCCCACCTGTCTGCAACCCAGCTGAGGCCATGCCCTCCCCAGG
GACCGTCTGCAGCCTCCTGCTCCTCGGCATGCTCTGGCTGGACTTGGCCATGGCAGGCTCCAG
CTTCCTGAGCCCTGAACACCAGAGAGTCCAGCAGAGAAAGGAGTCGAAGAAGCCACCAGCCAA
GCTGCAGCCCCGAGCTCTAGCAGGCTGGCTCCGCCCGGAAGATGGAGGTCAAGCAGAAGGGGC
AGAGGATGAACTGGAAGTCCGGTTCAACGCCCCCTTTGATGTTGGAATCAAGCTGTCAGGGGT
TCAGTACCAGCAGCACAGCCAGGCCCTGGGGAAGTTTCTTCAGGACATCCTCTGGGAAGAGGC
CAAAGAGGCCCCAGCCGACAAGTGATCGCCCACAAGCCTTACTCACCTCTCTCTAAGTTTAGA
AGCGCTCATCTGGCTTTTCGCTTGCTTCTGCAGCAACTCCCACGACTGTTGTACAAGCTCAGG
AGGCGAATAAATGTTCAAACTGTA

FIGURE 442

MPSPGTVCSLLLLGMLWLDLAMAGSSFLSPEHQRVQQRKESKKPPAKLQPRALAGWLRPEDGG
QAEGAEDELEVRFNAPFDVGIKLSGVQYQQHSQALGKFLQDILWEEAKEAPADKO

FIGURE 443

CGGCCACAGCTGGCATGCTCTGCCTGATCGCCATCCTGCTGTATGTCCTCGTCCAGTACCTCG
TGAACCCCGGGGTGCTCCGCACGGACCCCAGATGTCAAGAAT<u>ATG</u>AACACGTGGCTGCTGTTC
CTCCCCCTGTTCCCGGTGCAGGTGCAGACCCTGATAGTCGTGATCATCGGGATGCTCGTGCTC
CTGCTGGACTTTCTTGGCTTGGTGCACCTGGGCCAGCTGCTCATCTTCCACATCTACCTGAGT
ATGTCCCCCACCCTAAGCCCCCGATCCCCCCAAGGCTGGGTGGTCAGAGCTGCTCATCTTACA
CCTCTACTTGAGTATGTCCCTAACCCTGAGCCCCCACGCCTGGGGCCAGAGTCTTTGTCCCC
CGTGTGCGCATGTGTTCAGGGTCAGCCTCTCCCAGAAGTGAGATCATGGACAAAAAGGGCAAA
TCACAGGAAGAAATTAAATCCATGAGGACCCAGCAGGCCCAGCAAGAAGCTGAACTCACGCCG
AGACCTGCAGGAGTGGTGCCAGGTGCT<u>TGA</u>AGTAACAAGTTTAAAATGTTCAGAGACAATGGA
ATGGAATCTATTAGGCAAGAACAGGACATTATGAAATAAGGACAGGTGGACTTCCAAAAACAC
AAGTAGAAATTCTAACAATGAAATATATTACAGGCAGGTCACCCACTAACCAAACAACTGAAG
CGAGAGCTGTGGTCTTGCTTGGTCTCACAGTGGGCACAGCGGTAGGCGGTCAGTCATGTTGCT
GAACGACGGAGGGTAAACTCCCCAGCCCCAAGAAAACCTGTGTTGGAAGTAACAACAACCTCC
CTGCTCCTGGCACCAGCCGTTTTGGTCATGGTGGGCCAGCTGCAAAGCGTCTTCCATTCTCTG
GGCAGTGGTGGCCCCGAGGCTGTGGCCTCTCAGGGGGTTTCTGTGGACACGGGCAGCAGAGTG
TGTCCAGGCCAGCCCCCAAGAATGCCCTGCTCCTGACAGCTTGGCCAACCCCTGGTCAGGGCA
GAGGGAGTTGGGTGGGTCAGGCTCTGGGCTCACCTCCATCTCCAGAGCATCCCCTGCCTGCAG
TTGTGGCAAGAACGCCCAGCTCAGAATGAACACACCCCACCAAGAGCCTCCTTGTTCATAACC
ACAGGTTACCCTACAAACCACTGTCCCCACACAACCCTGGGGATGTTTTAAAACACACACCTC
TAACGCATATCTTACAGTCACTGTTGTCTTGCCTGAGGGTTGAATTTTTTTTAATGAAAGTGC
AATGAAAATCACTGGATTAAATCCTACGGACACAGAGCTGAAAAAAAAAAAAAAAAAAAAAAA
AAAAAAAA

FIGURE 444

MNTWLLFLPLFPVQVQTLIVVIIGMLVLLLDFLGLVHLGQLLIFHIYLSMSPTLSPRSPQGWV
VRAAHLTPLLEYVPNPEPPTPGARVFVPRVRMCSGSASPRSEIMDKKGKSQEEIKSMRTQQAQ
QEAELTPRPAGVVPGA

FIGURE 445

AGGCGGGCAGCAGCTGCAGGCTGACCTTGCAGCTTGGCGGA<u>ATG</u>GACTGGCCTCACAACCTGC
TGTTTCTTCTTACCATTTCCATCTTCCTGGGGCTGGGCCAGCCCAGGAGCCCCAAAAGCAAGA
GGAAGGGGCAAGGGCGGCCTGGGCCCCTGGCCCCTGGCCCTCACCAGGTGCCACTGGACCTGG
TGTCACGGATGAAACCGTATGCCCGCATGGAGGAGTATGAGAGGAACATCGAGGAGATGGTGG
CCCAGCTGAGGAACAGCTCAGAGCTGGCCCAGAGAAAGTGTGAGGTCAACTTGCAGCTGTGGA
TGTCCAACAAGAGGAGCCTGTCTCCCTGGGGCTACAGCATCAACCACGACCCCAGCCGTATCC
CCGTGGACCTGCCGGAGGCACGGTGCCTGTGTCTGGGCTGTGTGAACCCCTTCACCATGCAGG
AGGACCGCAGCATGGTGAGCGTGCCGGTGTTCAGCCAGGTTCCTGTGCGCCGCCGCCTCTGCC
CGCCACCGCCCCGCACAGGGCCTTGCCGCCAGCGCGCAGTCATGGAGACCATCGCTGTGGGCT
GCACCTGCATCTTC<u>TGA</u>ATCACCTGGCCCAGAAGCCAGGCCAGCAGCCCGAGACCATCCTCCT
TGCACCTTTGTGCCAAGAAAGGCCTATGAAAAGTAAACACTGACTTTTGAAAGCAAG

FIGURE 446

MDWPHNLLFLLTISIFLGLGQPRSPKSKRKGQGRPGPLAPGPHQVPLDLVSRMKPYARMEEYE
RNIEEMVAQLRNSSELAQRKCEVNLQLWMSNKRSLSPWGYSINHDPSRIPVDLPEARCLCLGC
VNPFTMQEDRSMVSVPVFSQVPVRRRLCPPPPRTGPCRQRAVMETIAVGCTCIF

Important features:

Signal peptide:

amino acids 1-20

N-glycosylation site.

amino acids 75-78

Homologous region to IL-17 amino acids 96-180.

FIGURE 447

GGAGTGCAGATGGCATCCTTCGGTTCTTCCAGACAAGCTGCAAGACGCTGACC<u>ATG</u>GCCAAGA
TGGAGCTCTCGAAGGCCTTCTCTGGCCAGCGGACACTCCTATCTGCCATCCTCAGCATGCTAT
CACTCAGCTTCTCCACAACATCCCTGCTCAGCAACTACTGGTTTGTGGGCACACAGAAGGTGC
CCAAGCCCCTGTGCGAGAAAGGTCTGGCAGCCAAGTGCTTTGACATGCCAGTGTCCCTGGATG
GAGATACCAACACATCCACCCAGGAGGTGGTACAATACAACTGGGAGACTGGGGATGACCGGT
TCTCCTTCCGGAGCTTCCGGAGTGGCATGTGGCTATCCTGTGAGGAAACTGTGGAAGAACCAG
GGGAGAGGTGCCGAAGTTTCATTGAACTTACACCACCAGCCAAGAGAGGTGAGAAAGGACTAC
TGGAATTTGCCACGTTGCAAGGCCCATGTCACCCCACTCTCCGATTTGGAGGGAAGCGGTTGA
TGGAGAAGGCTTCCCTCCCCTCCCCTCCCTTGGGGCTTTGTGGCAAAAATCCTATGGTTATCC
CTGGGAACGCAGATCACCTACATCGGACTTCAATTCATCAGCTTCCTCCTGCTACTAACAGAC
TTGCTACTCACTGGGAACCCTGCCTGTGGGCTCAAACTGAGCGCCTTTGCTGCTGTTTCCTCT
GTCCTGTCAGGTCTCCTGGGGATGGTGGCCCACATGATGTATTCACAAGTCTTCCAAGCGACT
GTCAACTTGGGTCCAGAAGACTGGAGACCACATGTTTGGAATTATGGCTGGGCCTTCTACATG
GCCTGGCTCTCCTTCACCTGCTGCATGGCGTCGGCTGTCACCACCTTCAACACGTACACCAGG
ATGGTGCTGGAGTTCAAGTGCAAGCA<u>TAG</u>TAAGAGCTTCAAGGAAAACCCGAACTGCCTACCA
CATCACCATCAGTGTTTCCCTCGGCGGCTGTCAAGTGCAGCCCCACCGTGGGTCCTTTGACC
AGCTACCACCAGTATCATAATCAGCCCATCCACTCTGTCTCTGAGGGAGTCGACTTCTACTCC
GAGCTGCGGAACAAGGGATTTCAAAGAGGGGCCAGCCAGGAGCTGAAAGAAGCAGTTAGGTCA
TCTGTAGAGGAAGAGCAGTGTTAGGAGTTAAGCGGGTTTGGGGAGTAGGCTTGAGCCCTACCT
TACACGTCTGCTGATTATCAACATGTGCTTAAGCCAACATCCGTCTCTTGAGCATGGTTTTTA
GAGGCTACGAATAAGGCTATGAATAAGGGTTATCTTTAAGTCCTAAGGGATTCCTGGGTGCCA
CTGCTCTCTTTTCCTCTACAGCTCCATCTTGTTTCACCCACCCCACATCTCACACATCCAGAA
TTCCCTTCTTTACTGATAGTTTCTGTGCCAGGTTCTGGGCTAAACCATGGAGATAAAAGAAG
AGTAAAATACACTTCCCGACCTTAAGGATCTGAAA

FIGURE 448

MAKMELSKAFSGQRTLLSAILSMLSLSFSTTSLLSNYWFVGTQKVPKPLCEKGLAAKCFDMPV
SLDGDTNTSTQEVVQYNWETGDDRFSFRSFRSGMWLSCEETVEEPGERCRSFIELTPPAKRGE
KGLLEFATLQGPCHPTLRFGGKRLMEKASLPSPPLGLCGKNPMVIPGNADHLHRTSIHQLPPA
TNRLATHWEPCLWAQTERLCCCFLCPVRSPGDGGPHDVFTSLPSDCQLGSRRLETTCLELWLG
LLHGLALLHLLHGVGCHHLQHVHQDGAGVQVQA

FIGURE 449

```
CCCACGCGTCCGCCCACGCGTCCGCCCACGCGTCCGCCCACGCGTCCGCCCACGCGTCCGCCCACGCGTCCGCCC
ACGCGTCCGGTGCAAGCTCGCGCCGCACACTGCCTGGTGGAGGGAAGGAGCCCGGGCGCCTCTCGCCGCTCCCCG
CGCCGCCGTCCGCACCTCCCCACCGCCCGCCGCCCCGCCGCCCGCCCCGCAAAGCATGAGTGAGCCCGCTCTCT
GCAGCTGCCCGGGGCGCGAATGGCAGGCTGTTTCCGCGGAGTAAAAGGTGGCGCCGGTCAGTGGTCGTTTCCAAT
GACGGACATTAACCAGACTGTCAGATCCTGGGGAGTCGCGAGCCCCGAGTTTGGAGTTTTTTCCCCCCACAACGT
CACAGTCCGAACTGCAGAGGGAAAGGAAGGCGGCAGGAAGGCGAAGCTCGGGCTCCGGCACGTAGTTGGGAAACT
TGCGGGTCCTAGAAGTCGCCTCCCCGCCTTGCCGGCCGCCCTTGCAGCCCCGAGCCGAGCAGCAAAGTGAGACAT
TGTGCGCCTGCCAGATCCGCCGGCCGCGGACCGGGGCTGCCTCGGAAACACAGAGGGGTCTTCTCTCGCCCTGCA
TATAATTAGCCTGCACACAAGGGAGCAGCTGAATGGAGGTTGTCACTCTCTGGAAAAGGATTTCTGACCGAGCG
CTTCCAATGGACATTCTCCAGTCTCTCTGGAAAGATTCTCGCTAATGGATTTCCTGCTGCTCGGTCTCTGTCTAT
ACTGGCTGCTGAGGAGGCCCTCGGGGGTGGTCTTGTGTCTGCTGGGGGCCTGCTTTCAGATGCTGCCCGCCGCCC
CCAGCGGGTGCCCGCAGCTGTGCCGGTGCGAGGGGCGGCTGCTGTACTGCGAGGCGCTCAACCTCACCGAGGCGC
CCCACAACCTGTCCGGCCTGCTGGGCTTGTCCCTGCGCTACAACAGCCTCTCGGAGCTGCGCGCCGGCCAGTTCA
CGGGGTTAATGCAGCTCACGTGGCTCTATCTGGATCACAATCACATCTGCTCCGTGCAGGGGGACGCCTTTCAGA
AACTGCGCCGAGTTAAGGAACTCACGCTGAGTTCCAACCAGATCACCCAACTGCCCAACACCACCTTCCGGCCCA
TGCCCAACCTGCGCAGCGTGGACCTCTCGTACAACAAGCTGCAGGCGCTCGCGCCCGACCTCTTCCACGGGCTGC
GGAAGCTCACCACGCTGCATATGCGGGCCAACGCCATCCAGTTTGTGCCCGTGCGCATCTTCCAGGACTGCCGCA
GCCTCAAGTTTCTCGACATCGGATACAATCAGCTCAAGAGTCTGGCGCGCAACTCTTTCGCCGGCTTGTTTAAGC
TCACCGAGCTGCACCTCGAGCACAACGACTTGGTCAAGGTGAACTTCGCCCACTTCCCGCGCCTCATCTCCCTGC
ACTCGCTCTGCCTGCGGAGGAACAAGGTGGCCATTGTGGTCAGCTCGCTGGACTGGGTTTGGAACCTGGAGAAAA
TGGACTTGTCGGGCAACGAGATCGAGTACATGGAGCCCCATGTGTTCGAGACCGTGCCGCACCTGCAGTCCCTGC
AGCTGGACTCCAACCGCCTCACCTACATCGAGCCCCGGATCCTCAACTCTTGGAAGTCCCTGACAAGCATCACCC
TGGCCGGGAACCTGTGGGATTGCGGGCGCAACGTGTGTGCCCTAGCCTCGTGGCTCAGCAACTTCCAGGGGCGCT
ACGATGGCAACTTGCAGTGCGCCAGCCCGGAGTACGCACAGGGCGAGGACGTCCTGGACGCCGTGTACGCCTTCC
ACCTGTGCGAGGATGGGGCCGAGCCCACCAGCGGCCACCTGCTCTCGGCCGTCACCAACCGCAGTGATCTGGGGC
CCCCTGCCAGCTCGGCCACCACGCTCGCGGACGGCGGGGAGGGGCAGCACGACGGCACATTCGAGCCTGCCACCG
TGGCTCTTCCAGGCGGCGAGCACGCCGAGAACGCCGTGCAGATCCACAAGGTGGTCACGGGCACCATGGCCCTCA
TCTTCTCCTTCCTCATCGTGGTCCTGGTGCTCTACGTGTCCTGGAAGTGTTTCCCAGCCAGCCTCAGGCAGCTCA
GACAGTGCTTTGTCACGCAGCGCAGGAAGCAAAAGCAGAAACAGACCATGCATCAGATGGCTGCCATGTCTGCCC
AGGAATACTACGTTGATTACAAACCGAACCACATTGAGGGAGCCCTGGTGATCATCAACGAGTATGGCTCGTGTA
CCTGCCACCAGCAGCCCGCGAGGGAATGCGAGGTGTGATTGTCCCAGTGGCTCTCAACCCATGCGCTACCAAATA
CGCCTGGGCAGCCGGGACGGGCCGGCGGGCACCAGGCTGGGGTCTCCTTGTCTGTGCTCTGATATGCTCCTTGAC
TGAAACTTTAAGGGGATCTCTCCCAGAGACTTGACATTTTAGCTTTATTGTGTCTTAAAAACAAAAGCGAATTAA
AACACAACAAAAAACCCCACCCCACAACCTTCAGGACAGTCTATCTTAAATTTCATATGAGAACTCCTTCCTCCC
TTTGAAGATCTGTCCATATTCAGGAATCTGAGAGTGTAAAAAAGGTGGCCATAAGACAGAGAGAGAGAATAATCGTG
CTTTGTTTTATGCTACTCCTCCCACCCTGCCCATGATTAAACATCATGTATGTAGAAGATCTTAAGTCCATACGC
ATTTCATGAAGAACCATTGGAAAGAGGAATCTGCAATCTGGGAGCTTAAGAGCAAATGATGACCATAGAAAGCTA
TGTTCTTACTTTGTGTGTGTGTCTGTATGTTTCTGCGTTGTGTGTCTTTGTAGGCAAGCAAACGTTGTCTACACA
AACGGGAATTTAGCTCACATCATTTCATGCCCCTGTGCCTCTAGCTCTGGAGATTGGTGGGGGGAGGTGGGGGGA
AACGGCAGGAATAAGGGAAAGTGGTAGTTTTAACTAAGGTTTTGTAACACTTGAAATCTTTTCTTTCTCAAATTA
ATTATCTTTAAGCTTCAAGAAACTTGCTCTGACCCCTCTAAGCAAACTACTAAGCATTTAAAAGAGAATCTAATT
TTTAAAGGTGTAGCACCTTTTTTTTTTATTCTTCCCACAGAGGGCTGCTAATCTCATTATGCTGTGCTATCTGAAAA
GAACTTAAGGCCACAATTCACGTCTCGTCCTGGGCATTGTGATGGATTGACCCTCCATTTGCAGTACCTTCCCAG
CTGATTAAAGTTCAGCAGTGGTATTGAGGTTTTTCGAATATTTATATAGAAAAAAAGTCTTTTCACATGACAAAT
GACACTCTCACACCAGTCTTAGCCCTAGTAGTTTTTAGGTTGGACCAGAGGAAGCAGGTTAAATGAGACCTGTC
CTCTGCTGCACTCAGAAAAAATAGGCAGTCCCTGATGCTCAGATCTTAGCCTTGATATTAATAGTTGAGACCACC
TACCCACAATGCAGCCTATACTCCCAAGACTACAAAGTTACCATCGCAAAGGAAAGGTTATTCCAGTAAAAGGAA
ATAGTTTTCTCAACCATTTAAAAATATTCTTCTGAACTCATCAAAGTAGAAGAGCCCCCAACCTTTTCTCTCTGC
CTTCAAGAAGGCAGACATTTGGTATGATTTAGCATCAACAACACATTTATGAGTATATGTAAGTAATCAGAGGGG
CAAATGCCACTTGTTATTCCTCCCAAGTTTTCCAAGCAAGTACACACAGATCTCTGTAGGATTAGGGGCCACTT
GTGTTTCCGGCTTATTTTAGTCGACTTGTCAGCAAGTTTGATGCCTAGTCTATCTGACATGGCCCAGTAGAACAG
GGCATTGATGGATCACATGAGATGGTAGAAGGAACATCATCACATACCCCTCTCACAGAGAAAATTATCAAAGAA
CCAGAAATTATATCTGTTTTGGAGCAAGAGTGTCATAATGTTTCAGGGTAGTCAAAATAAACATAAATTATCTCC
TCTAGATGAGTGGCGATGTTGGCTGATTTGGGTCTGCCATTGACAGAATGTCAAATAAAAAGGAATTAGCTAGAA
TATGACCATTAAATGTGCTTCTGAAATATATTTTGAGATAGGTTTAGAATGTCA
```

FIGURE 450

MDFLLLGLCLYWLLRRPSGVVLCLLGACFQMLPAAPSGCPQLCRCEGRLLYCEALNLTEAPHN
LSGLLGLSLRYNSLSELRAGQFTGLMQLTWLYLDHNHICSVQGDAFQKLRRVKELTLSSNQIT
QLPNTTFRPMPNLRSVDLSYNKLQALAPDLFHGLRKLTTLHMRANAIQFVPVRIFQDCRSLKF
LDIGYNQLKSLARNSFAGLFKLTELHLEHNDLVKVNFAHFPRLISLHSLCLRRNKVAIVVSSL
DWVWNLEKMDLSGNEIEYMEPHVFETVPHLQSLQLDSNRLTYIEPRILNSWKSLTSITLAGNL
WDCGRNVCALASWLSNFQGRYDGNLQCASPEYAQGEDVLDAVYAFHLCEDGAEPTSGHLLSAV
TNRSDLGPPASSATTLADGGEGQHDGTFEPATVALPGGEHAENAVQIHKVVTGTMALIFSFLI
VVLVLYVSWKCFPASLRQLRQCFVTQRRKQKQTMHQMAAMSAQEYYVDYKPNHIEGALVII
NEYGSCTCHQQPARECEV

FIGURE 451

```
TTGAGCGCAGGTGAGCTCCTGCGCGTTCCGGGGCGTTCCTCCAGTCACCCTCCCGCCGTTAC
CCGCGGCGCGCCCGAGGGAGTCTCCTCCAGACCCTCCCTCCCGTTGCTCCAAACTAATACGGA
CTGAACGGATCGCTGCGAGGGTGGGAGAGAAAATTAGGGGGAGAAAGGACAGAGAGAGCAACT
ACCATCCATAGCCAGATAGATTATCTTACACTGAACTGATCAAGTACTTTGAAAATGACTTCG
AAATTTATCTTGGTGTCCTTCATACTTGCTGCACTGAGTCTTTCAACCACCTTTTCTCTCCAA
CTAGACCAGCAAAAGGTTCTACTAGTTTCTTTTGATGGATTCCGTTGGGATTACTTATATAAA
GTTCCAACGCCCCATTTTCATTATATTATGAAATATGGTGTTCACGTGAAGCAAGTTACTAAT
GTTTTTATTACAAAAACCTACCCTAACCATTATACTTTGGTAACTGGCCTCTTTGCAGAGAAT
CATGGGATTGTTGCAAATGATATGTTTGATCCTATTCGGAACAAATCTTTCTCCTTGGATCAC
ATGAATATTTATGATTCCAAGTTTTGGGAAGAAGCGACACCAATATGGATCACAAACCAGAGG
GCAGGACATACTAGTGGTGCAGCCATGTGGCCCGGAACAGATGTAAAAATACATAAGCGCTTT
CCTACTCATTACATGCCTTACAATGAGTCAGTTTCATTTGAAGATAGAGTTGCCAAAATTGTT
GAATGGTTTACGTCAAAAGAGCCCATAAATCTTGGTCTTCTCTATTGGGAAGACCCTGATGAC
ATGGGCCACCATTTGGGACCTGACAGTCCGCTCATGGGGCCTGTCATTTCAGATATTGACAAG
AAGTTAGGATATCTCATACAAATGCTGAAAAAGGCAAAGTTGTGGAACACTCTGAACCTAATC
ATCACAAGTGATCATGGAATGACGCAGTGCTCTGAGGAAAGGTTAATAGAACTTGACCAGTAC
CTGGATAAAGACCACTATACCCTGATTGATCAATCTCCAGTAGCAGCCATCTTGCCAAAAGAA
GGTAAATTTGATGAAGTCTATGAAGCACTAACTCACGCTCATCCTAATCTTACTGTTTACAAA
AAAGAAGACGTTCCAGAAAGGTGGCATTACAAATACAACAGTCGAATTCAACCAATCATAGCA
GTGGCTGATGAAGGGTGGCACATTTTACAGAATAAGTCAGATGACTTTCTGTTAGGCAACCAC
GGTTACGATAATGCGTTAGCAGATATGCATCCAATATTTTTAGCCCATGGTCCTGCCTTCAGA
AAGAATTTCTCAAAAGAAGCCATGAACTCCACAGATTTGTACCCACTACTATGCCACCTCCTC
AATATCACTGCCATGCCACACAATGGATCATTCTGGAATGTCCAGGATCTGCTCAATTCAGCA
ATGCCAAGGGTGGTCCCTTATACACAGAGTACTATACTCCTCCCTGGTAGTGTTAAACCAGCA
GAATATGACCAAGAGGGGTCATACCCTTATTTCATAGGGGTCTCTCTTGGCAGCATTATAGTG
ATTGTATTTTTTGTAATTTTCATTAAGCATTTAATTCACAGTCAAATACCTGCCTTACAAGAT
ATGCATGCTGAAATAGCTCAACCATTATTACAAGCCTAATGTTACTTTGAAGTGGATTTGCAT
ATTGAAGTGGAGATTCCATAATTATGTCAGTGTTTAAAGGTTTCAAATTCTGGGAAACCAGTT
CCAAACATCTGCAGAAACCATTAAGCAGTTACATATTTAGGTATACACACACACACACACACA
CACATACACACACACGGACCAAAATACTTACACCTGCAAAGGAATAAAGATGTGAGAGTATGT
CTCCATTGTTCACTGTAGCATAGGGATAGATAAGATCCTGCTTTATTTGGACTTGGCGCAGAT
AATGTATATATTTAGCAACTTTGCACTATGTAAAGTACCTTATATATTGCACTTTAAATTTCT
CTCCTGATGGGTACTTTAATTTGAAATGCACTTTATGGACAGTTATGTCTTATAACTTGATTG
AAAATGACAACTTTTTGCACCCATGTCACAGAATACTTGTTACGCATTGTTCAAACTGAAGGA
AATTTCTAATAATCCCGAATAATGAACATAGAAATCTATCTCCATAAATTGAGAGAAGAAGAA
GGTGATAAGTGTTGAAAATTAAATGTGATAACCTTTGAACCTTGAATTTTGGAGATGTATTCC
CAACAGCAGAATGCAACTGTGGGCATTTCTTGTCTTATTTCTTTCCAGAGAACGTGGTTTTCA
TTTATTTTTCCCTCAAAAGAGAGTCAAATACTGACAGATTCGTTCTAAATATATTGTTTCTGT
CATAAAATTATTGTGATTTCCTGATGAGTCATATTACTGTGATTTTCATAATAATGAAGACAC
CATGAATATACTTTTCTTCTATATAGTTCAGCAATGGCCTGAATAGAAGCAACCAGGCACCAT
CTCAGCAATGTTTTCTCTTGTTTGTAATTATTTGCTCCTTTGAAAATTAAATCACTATTAATT
ACATTAAAAATCAAATTGGATAAAAAAAAAAAAAAAAAAA
```

FIGURE 452

```
MTSKFILVSFILAALSLSTTFSLQLDQQKVLLVSFDGFRWDYLYKVPTPHFHYIMKYGVHVKQ
VTNVFITKTYPNHYTLVTGLFAENHGIVANDMFDPIRNKSFSLDHMNIYDSKFWEEATPIWIT
NQRAGHTSGAAMWPGTDVKIHKRFPTHYMPYNESVSFEDRVAKIVEWFTSKEPINLGLLYWED
PDDMGHHLGPDSPLMGPVISDIDKKLGYLIQMLKKAKLWNTLNLIITSDHGMTQCSEERLIEL
DQYLDKDHYTLIDQSPVAAILPKEGKFDEVYEALTHAHPNLTVYKKEDVPERWHYKYNSRIQP
IIAVADEGWHILQNKSDDFLLGNHGYDNALADMHPIFLAHGPAFRKNFSKEAMNSTDLYPLLC
HLLNITAMPHNGSFWNVQDLLNSAMPRVVPYTQSTILLPGSVKPAEYDQEGSYPYFIGVSLGS
IIVIVFFVIFIKHLIHSQIPALQDMHAEIAQPLLQA
```

Important features:

Signal Peptide:

amino acids 1-22

Transmembrane Domain:

amino acids 429-452

N-glycosylation sites:

amino acids 101-104, 158-161, 292-295, 329-332, 362-365, 369-372, 382-385, 389-392

Somatomedin B Domain:

amino acids 69-85

Sulfatase protein Region:

amino acids 212-241

FIGURE 453

```
GGCCGCCTGGAATTGTGGGAGTTGTGTCTGCCACTCGGCTGCCGGAGGCCGAAGGTCCGTGAC
TATGGCTCCCCAGAGCCTGCCTTCATCTAGGATGGCTCCTCTGGGCATGCTGCTTGGGCTGCT
GATGGCCGCCTGCTTCACCTTCTGCCTCAGTCATCAGAACCTGAAGGAGTTTGCCCTGACCAA
CCCAGAGAAGAGCAGCACCAAAGAAACGGAGAGAAAAGAAACCAAAGCCGAGGAGGAGCTGGA
TGCCGAAGTCCTGGAGGTGTTCCACCCGACGCATGAGTGGCAGGCCCTTCAGCCAGGGCAGGC
TGTCCCTGCAGGATCCCACGTACGGCTGAATCTTCAGACTGGGGAAAGAGAGGCAAAACTCCA
ATATGAGGACAAGTTCCGAAATAATTTGAAAGGCAAAAGGCTGGATATCAACACCAACACCTA
CACATCTCAGGATCTCAAGAGTGCACTGGCAAAATTCAAGGAGGGGCAGAGATGGAGAGTTC
AAAGGAAGACAAGGCAAGGCAGGCTGAGGTAAAGCGGCTCTTCCGCCCCATTGAGGAACTGAA
GAAAGACTTTGATGAGCTGAATGTTGTCATTGAGACTGACATGCAGATCATGGTACGGCTGAT
CAACAAGTTCAATAGTTCCAGCTCCAGTTTGGAAGAGAAGATTGCTGCGCTCTTTGATCTTGA
ATATTATGTCCATCAGATGGACAATGCGCAGGACCTGCTTTCCTTTGGTGGTCTTCAAGTGGT
GATCAATGGGCTGAACAGCACAGAGCCCTCGTGAAGGAGTATGCTGCGTTTGTGCTGGGCGC
TGCCTTTTCCAGCAACCCCAAGGTCCAGGTGGAGGCCATCGAAGGGGAGCCCTGCAGAAGCT
GCTGGTCATCCTGGCCACGGAGCAGCCGCTCACTGCAAAGAAGAAGGTCCTGTTTGCACTGTG
CTCCCTGCTGCGCCACTTCCCCTATGCCCAGCGGCAGTTCCTGAAGCTCGGGGGGCTGCAGGT
CCTGAGGACCCTGGTGCAGGAGAAGGGCACGGAGGTGCTCGCCGTGCGCGTGGTCACACTGCT
CTACGACCTGGTCACGGAGAAGATGTTCGCCGAGGAGGAGGCTGAGCTGACCCAGGAGATGTC
CCCAGAGAAGCTGCAGCAGTATCGCCAGGTACACCTCCTGCCAGGCCTGTGGGAACAGGGCTG
GTGCGAGATCACGGCCCACCTCCTGGCGCTGCCCGAGCATGATGCCCGTGAGAAGGTGCTGCA
GACACTGGGCGTCCTCCTGACCACCTGCCGGGACCGCTACCGTCAGGACCCCCAGCTCGGCAG
GACACTGGCCAGCCTGCAGGCTGAGTACCAGGTGCTGGCCAGCCTGGAGCTGCAGGATGGTGA
GGACGAGGGCTACTTCCAGGAGCTGCTGGGCTCTGTCAACAGCTTGCTGAAGGAGCTGAGATG
AGGCCCCACACCAGGACTGGACTGGGATGCCGCTAGTGAGGCTGAGGGGTGCCAGCGTGGGTG
GGCTTCTCAGGCAGGAGGACATCTTGGCAGTGCTGGCTTGGCCATTAAATGGAAACCTGAAGG
CCAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAA
```

FIGURE 454

MAPQSLPSSRMAPLGMLLGLLMAACFTFCLSHQNLKEFALTNPEKSSTKETERKETKAEEELD
AEVLEVFHPTHEWQALQPGQAVPAGSHVRLNLQTGEREAKLQYEDKFRNNLKGKRLDINTNTY
TSQDLKSALAKFKEGAEMESSKEDKARQAEVKRLFRPIEELKKDFDELNVVIETDMQIMVRLI
NKFNSSSSSLEEKIAALFDLEYYVHQMDNAQDLLSFGGLQVVINGLNSTEPLVKEYAAFVLGA
AFSSNPKVQVEAIEGGALQKLLVILATEQPLTAKKKVLFALCSLLRHFPYAQRQFLKLGGLQV
LRTLVQEKGTEVLAVRVVTLLYDLVTEKMFAEEEAELTQEMSPEKLQQYRQVHLLPGLWEQGW
CEITAHLLALPEHDAREKVLQTLGVLLTTCRDRYRQDPQLGRTLASLQAEYQVLASLELQDGE
DEGYFQELLGSVNSLLKELR

Important features:

Signal peptide:

amino acids 1-29

Hypothetical YJL126w/YLR351c/yhcX family protein.

amino acids 364-373

N-glycosylation site.

amino acids 193-197, 236-240

N-myristoylation site.

amino acids 15-21, 19-25, 234-240, 251-257, 402-408, 451-457

Homologous region SLS1 protein.

amino acids 68-340

FIGURE 455

GCCCCAGGGAGCAGTGGGTGGTTATAACTCAGGCCCGGTGCCCAGAGCCCAGGAGGAGGCAGT
GGCCAGGAAGGCACAGGCCTGAGAAGTCTGCGGCTGAGCTGGGAGCAAATCCCCCACCCCTA
CCTGGGGGACAGGGCAAGTGAGACCTGGTGAGGGTGGCTCAGCAGGCAGGGAAGGAGAGGTGT
CTGTGCGTCCTGCACCCACATCTTTCTCTGTCCCCTCCTTGCCCTGTCTGGAGGCTGCTAGAC
TCCTATCTTCTGAATTCTATAGTGCCTGGGTCTCAGCGCAGTGCCGATGGTGGCCCGTCCTTG
TGGTTCCTCTCTACCTGGGGAAATAAGGTGCAGCGGCC<u>ATG</u>GCTACAGCAAGACCCCCTGGA
TGTGGGTGCTCTGTGCTCTGATCACAGCCTTGCTTCTGGGGGTCACAGAGCATGTTCTCGCCA
ACAATGATGTTTCCTGTGACCACCCCTCTAACACCGTGCCCTCTGGGAGCAACCAGGACCTGG
GAGCTGGGGCCGGGGAAGACGCCCGGTCGGATGACAGCAGCAGCCGCATCATCAATGGATCCG
ACTGCGATATGCACACCCAGCCGTGGCAGGCCGCGCTGTTGCTAAGGCCCAACCAGCTCTACT
GCGGGGCGGTGTTGGTGCATCCACAGTGGCTGCTCACGGCCGCCCACTGCAGGAAGAAAGTTT
TCAGAGTCCGTCTCGGCCACTACTCCCTGTCACCAGTTTATGAATCTGGGCAGCAGATGTTCC
AGGGGGTCAAATCCATCCCCCACCCTGGCTACTCCCACCCTGGCCACTCTAACGACCTCATGC
TCATCAAACTGAACAGAAGAATTCGTCCCACTAAAGATGTCAGACCCATCAACGTCTCCTCTC
ATTGTCCCTCTGCTGGGACAAAGTGCTTGGTGTCTGGCTGGGGACAACCAAGAGCCCCCAAG
TGCACTTCCCTAAGGTCCTCCAGTGCTTGAATATCAGCGTGCTAAGTCAGAAAAGGTGCGAGG
ATGCTTACCCGAGACAGATAGATGACACCATGTTCTGCGCCGGTGACAAAGCAGGTAGAGACT
CCTGCCAGGGTGATTCTGGGGGGCCTGTGGTCTGCAATGGCTCCCTGCAGGGACTCGTGTCCT
GGGGAGATTACCCTTGTGCCCGGCCCAACAGACCGGGTGTCTACACGAACCTCTGCAAGTTCA
CCAAGTGGATCCAGGAAACCATCCAGGCCAACTCC<u>TGA</u>GTCATCCCAGGACTCAGCACACCGG
CATCCCCACCTGCTGCAGGGACAGCCCTGACACTCCTTTCAGACCCTCATTCCTTCCCAGAGA
TGTTGAGAATGTTCATCTCTCCAGCCCCTGACCCCATGTCTCCTGGACTCAGGGTCTGCTTCC
CCCACATTGGGCTGACCGTGTCTCTCTAGTTGAACCCTGGGAACAATTTCCAAAACTGTCCAG
GGCGGGGGTTGCGTCTCAATCTCCCTGGGGCACTTTCATCCTCAAGCTCAGGGCCCATCCCTT
CTCTGCAGCTCTGACCCAAATTTAGTCCCAGAAATAAACTGAGAAGTGGAAAAAAAAA

FIGURE 456

MATARPPWMWVLCALITALLLGVTEHVLANNDVSCDHPSNTVPSGSNQDLGAGAGEDARSDDS
SSRIINGSDCDMHTQPWQAALLLRPNQLYCGAVLVHPQWLLTAAHCRKKVFRVRLGHYSLSPV
YESGQQMFQGVKSIPHPGYSHPGHSNDLMLIKLNRRIRPTKDVRPINVSSHCPSAGTKCLVSG
WGTTKSPQVHFPKVLQCLNISVLSQKRCEDAYPRQIDDTMFCAGDKAGRDSCQGDSGGPVVCN
GSLQGLVSWGDYPCARPNRPGVYTNLCKFTKWIQETIQANS

FIGURE 457

GCAGTCAGAGACTTCCCCTGCCCCTCGCTGGGAAAGAACATTAGGAATGCCTTTTAGTGCCTTGCTTCCTGAACT
AGCTCACAGTAGCCCGGCGGCCCAGGGCAATCCGACCACATTTCACTCTCACCGCTGTAGGAATCCAGATGCAGG
CCAAGTACAGCAGCACGAGGGACATGCTGGATGATGATGGGGACACCACCATGAGCCTGCATTCTCAAGCCTCTG
CCACAACTCGGCATCCAGAGCCCCGGCGCACAGAGCACAGGGCTCCCTCTTCAACGTGGCGACCAGTGGCCCTGA
CCCTGCTGACTTTGTGCTTGGTGCTGCTGATAGGGCTGGCAGCCCTGGGGCTTTTGTTTTTTCAGTACTACCAGC
TCTCCAATACTGGTCAAGACACCATTTCTCAAATGGAAGAAAGATTAGGAAATACGTCCCAAGAGTTGCAATCTC
TTCAAGTCCAGAATATAAAGCTTGCAGGAAGTCTGCAGCATGTGGCTGAAAAACTCTGTCGTGAGCTGTATAACA
AAGCTGGAGCACACAGGTGCAGCCCTTGTACAGAACAATGGAAATGGCATGGAGACAATTGCTACCAGTTCTATA
AAGACAGCAAAAGTTGGGAGGACTGTAAATATTTCTGCCTTAGTGAAAACTCTACCATGCTGAAGATAAACAAAC
AAGAAGACCTGGAATTTGCCGCGTCTCAGAGCTACTCTGAGTTTTTCTACTCTTATTGGACAGGGCTTTTGCGCC
CTGACAGTGGCAAGGCCTGGCTGTGGATGGATGGAACCCCTTTCACTTCTGAACTGTTCCATATTATAATAGATG
TCACCAGCCCAAGAAGCAGAGACTGTGTGGCCATCCTCAATGGGATGATCTTCTCAAAGGACTGCAAAGAATTGA
AGCGTTGTGTCTGTGAGAGAAGGGCAGGAATGGTGAAGCCAGAGAGCCTCCATGTCCCCCCTGAAACATTAGGCG
AAGGTGACTGATTCGCCCTCTGCAACTACAAATAGCAGAGTGAGCCAGGCGGTGCCAAAGCAAGGGCTAGTTGAG
ACATTGGGAAATGGAACATAATCAGGAAAGACTATCTCTCTGACTAGTACAAAATGGGTTCTCGTGTTTCCTGTT
CAGGATCACCAGCATTTCTGAGCTTGGGTTTATGCACGTATTTAACAGTCACAAGAAGTCTTATTTACATGCCAC
CAACCAACCTCAGAAACCCATAATGTCATCTGCCTTCTTGGCTTAGAGATAACTTTTAGCTCTCTTTCTTCTCAA
TGTCTAATATCACCTCCCTGTTTTCATGTCTTCCTTACACTTGGTGGAATAAGAAACTTTTTGAAGTAGAGGAAA
TACATTGAGGTAACATCCTTTTCTCTGACAGTCAAGTAGTCCATCAGAAATTGGCAGTCACTTCCCAGATTGTAC
CAGCAAATACACAAGGAATTCTTTTTGTTTGTTTCAGTTCATACTAGTCCCTTCCCAATCCATCAGTAAAGACCC
CATCTGCCTTGTCCATGCCGTTTCCCAACAGGGATGTCACTTGATATGAGAATCTCAAATCTCAATGCCTTATAA
GCATTCCTTCCTGTGTCCATTAAGACTCTGATAATTGTCTCCCCTCCATAGGAATTTCTCCCAGGAAAGAAATAT
ATCCCCATCTCCGTTTCATATCAGAACTACCGTCCCCGATATTCCCTTCAGAGAGATTAAAGACCAGAAAAAAGT
GAGCCTCTTCATCTGCACCTGTAATAGTTTCAGTTCCTATTTTCTTCCATTGACCCATATTTATACCTTTCAGGT
ACTGAAGATTTAATAATAATAAATGTAAATACTGTGAAAAA

FIGURE 458

MQAKYSSTRDMLDDDGDTTMSLHSQASATTRHPEPRRTEHRAPSSTWRPVALTLLTLCLVLLI
GLAALGLLFFQYYQLSNTGQDTISQMEERLGNTSQELQSLQVQNIKLAGSLQHVAEKLCRELY
NKAGAHRCSPCTEQWKWHGDNCYQFYKDSKSWEDCKYFCLSENSTMLKINKQEDLEFAASQSY
SEFFYSYWTGLLRPDSGKAWLWMDGTPFTSELFHIIIDVTSPRSRDCVAILNGMIFSKDCKEL
KRCVCERRAGMVKPESLHVPPETLGEGD

FIGURE 459

```
GTTGATGGCAAACTTCCTCAAAGGAGGGGCAGAGCCTGCGCAGGGCAGGAGCAGCTGGCCCAC
TGGCGGCCCGCAACACTCCGTCTCACCCTCTGGGCCCACTGCATCTAGAGGAGGGCCGTCTGT
GAGGCCACTACCCCTCCAGCAACTGGGAGGTGGGACTGTCAGAAGCTGGCCCAGGGTGGTGGT
CAGCTGGGTCAGGGACCTACGGCACCTGCTGGACCACCTCGCCTTCTCCATCGAAGCAGGGAA
GTGGGAGCCTCGAGCCCTCGGGTGGAAGCTGACCCCAAGCCACCCTTCACCTGGACAGGATGA
GAGTGTCAGGTGTGCTTCGCCTCCTGGCCCTCATCTTTGCCATAGTCACGACATGGATGTTTA
TTCGAAGCTACATGAGCTTCAGCATGAAAACCATCCGTCTGCCACGCTGGCTGGCAGCCTCGC
CCACCAAGGAGATCCAGGTTAAAAAGTACAAGTGTGGCCTCATCAAGCCCTGCCCAGCCAACT
ACTTTGCGTTTAAAATCTGCAGTGGGGCCGCCAACGTCGTGGGCCCTACTATGTGCTTTGAAG
ACCGCATGATCATGAGTCCTGTGAAAAACAATGTGGGCAGAGGCCTAAACATCGCCCTGGTGA
ATGGAACCACGGGAGCTGTGCTGGGACAGAAGGCATTTGACATGTACTCTGGAGATGTTATGC
ACCTAGTGAAATTCCTTAAAGAAATTCCGGGGGGTGCACTGGTGCTGGTGGCCTCCTACGACG
ATCCAGGGACCAAAATGAACGATGAAAGCAGGAAACTCTTCTCTGACTTGGGGAGTTCCTACG
CAAAACAACTGGGCTTCCGGGACAGCTGGGTCTTCATAGGAGCCAAAGACCTCAGGGGTAAAA
GCCCCTTTGAGCAGTTCTTAAAGAACAGCCCAGACACAAACAAATACGAGGGATGGCCAGAGC
TGCTGGAGATGGAGGGCTGCATGCCCCGAAGCCATTTTAGGGTGGCTGTGGCTCTTCCTCAG
CCAGGGGCCTGAAGAAGCTCCTGCCTGACTTAGGAGTCAGAGCCCGGCAGGGGCTGAGGAGGA
GGAGCAGGGGGTGCTGCGTGGAAGGTGCTGCAGGTCCTTGCACGCTGTGTCGCGCCTCTCCTC
CTCGGAAACAGAACCCTCCCACAGCACATCCTACCCGGAAGACCAGCCTCAGAGGGTCCTTCT
GGAACCAGCTGTCTGTGGAGAGAATGGGGTGCTTTCGTCAGGGACTGCTGACGGCTGGTCCTG
AGGAAGGACAAACTGCCCAGACTTGAGCCCAATTAAATTTTATTTTTGCTGGTTTTGAAAAAA
AAAAAAAAAAAAA
```

FIGURE 460

MRVSGVLRLLALIFAIVTTWMFIRSYMSFSMKTIRLPRWLAASPTKEIQVKKYKCGLIKPCPA
NYFAFKICSGAANVVGPTMCFEDRMIMSPVKNNVGRGLNIALVNGTTGAVLGQKAFDMYSGDV
MHLVKFLKEIPGGALVLVASYDDPGTKMNDESRKLFSDLGSSYAKQLGFRDSWVFIGAKDLRG
KSPFEQFLKNSPDTNKYEGWPELLEMEGCMPPKPF

Important features:

Signal peptide:

amino acids 1-15

ATP/GTP-binding site motif A (P-loop).

amino acids 184-191

N-glycosylation site.

amino acids 107-110

FIGURE 461

AAACTCAGCACTTGCCGGAGTGGCTCATTGTTAAGACAAAGGGTGTGCACTTCCTGGCCAGGA
AACCTGAGCGGTGAGACTCCCAGCTGCCTACATCAAGGCCCCAGGACATGCAGAACCTTCCTC
TAGAACCCGACCCACCACCATGAGGTCCTGCCTGTGGAGATGCAGGCACCTGAGCCAAGGCGT
CCAGTGGTCCTTGCTTCTGGCTGTCCTGGTCTTCTTTCTCTTCGCCTTGCCCTCTTTTATTAA
GGAGCCTCAAACAAAGCCTTCCAGGCATCAACGCACAGAGAACATTAAAGAAAGGTCTCTACA
GTCCCTGGCAAAGCCTAAGTCCCAGGCACCCACAAGGGCGAGGAGGACAACCATCTATGCAGA
GCCAGCGCCAGAGAACAATGCCCTCAACACACAAACCCAGCCCAAGGCCCACACCACCGGAGA
CAGAGGAAAGGAGGCCAACCAGGCACCGCCGGAGGAGCAGGACAAGGTGCCCCACACAGCACA
GAGGGCAGCATGGAAGAGCCCAGAAAAGAGAAAACCATGGTGAACACACTGTCACCCAGAGG
GCAAGATGCAGGGATGGCCTCTGGCAGGACAGAGGCACAATCATGGAAGAGCCAGGACACAAA
GACGACCCAAGGAAATGGGGCCAGACCAGGAAGCTGACGGCCTCCAGGACGGTGTCAGAGAA
GCACCAGGGCAAAGCGGCAACCACAGCCAAGACGCTCATTCCCAAAAGTCAGCACAGAATGCT
GGCTCCCACAGGAGCAGTGTCAACAAGGACGAGACAGAAAGGAGTGACCACAGCAGTCATCCC
ACCTAAGGAGAAGAAACCTCAGGCCACCCCACCCCCTGCCCCTTTCCAGAGCCCCACGACGCA
GAGAAACCAAAGACTGAAGGCCGCCAACTTCAAATCTGAGCCTCGGTGGGATTTTGAGGAAAA
ATACAGCTTCGAAATAGGAGGCCTTCAGACGACTTGCCCTGACTCTGTGAAGATCAAAGCCTC
CAAGTCGCTGTGGCTCCAGAAACTCTTTCTGCCCAACCTCACTCTCTTCCTGGACTCCAGACA
CTTCAACCAGAGTGAGTGGGACCGCCTGGAACACTTTGCACCACCCTTTGGCTTCATGGAGCT
CAACTACTCCTTGGTGCAGAAGGTCGTGACACGCTTCCCTCCAGTGCCCCAGCAGCAGCTGCT
CCTGGCCAGCCTCCCCGCTGGGAGCCTCCGGTGCATCACCTGTGCCGTGGTGGGCAACGGGGG
CATCCTGAACAACTCCCACATGGGCCAGGAGATAGACAGTCACGACTACGTGTTCCGATTGAG
CGGAGCTCTCATTAAAGGCTACGAACAGGATGTGGGGACTCGGACATCCTTCTACGGCTTTAC
CGCCTTCTCCCTGACCCAGTCACTCCTTATATTGGGCAATCGGGGTTTCAAGAACGTGCCTCT
TGGGAAGGACGTCCGCTACTTGCACTTCCTGGAAGGCACCCGGGACTATGAGTGGCTGGAAGC
ACTGCTTATGAATCAGACGGTGATGTCAAAAAACCTTTTCTGGTTCAGGCACAGACCCCAGGA
AGCTTTTCGGGAAGCCCTGCACATGGACAGGTACCTGTTGCTGCACCCAGACTTTCTCCGATA
CATGAAGAACAGGTTTCTGAGGTCTAAGACCCTGGATGGTGCCCACTGGAGGATATACCGCCC
CACCACTGGGGCCCTCCTGCTGCTCACTGCCCTTCAGCTCTGTGACCAGGTGAGTGCTTATGG
CTTCATCACTGAGGGCCATGAGCGCTTTTCTGATCACTACTATGATACATCATGGAAGCGGCT
GATCTTTTACATAAACCATGACTTCAAGCTGGAGAGAGAAGTCTGGAAGCGGCTACACGATGA
AGGGATAATCCGGCTGTACCAGCGTCCTGGTCCCGGAACTGCCAAAGCCAAGAACTGACCGGG
GCCAGGGCTGCCATGGTCTCCTTGCCTGCTCCAAGGCACAGGATACAGTGGGAATCTTGAGAC
TCTTTGGCCATTTCCCATGGCTCAGACTAAGCTCCAAGCCCTTCAGGAGTTCCAAGGGAACAC
TTGAACCATGGACAAGACTCTCTCAAGATGGCAAATGGCTAATTGAGGTTCTGAAGTTCTTCA
GTACATTGCTGTAGGTCCTGAGGCAGGGATTTTTAATTAAATGGGGTGATGGGTGGCCAATA
CCACAATTCCTGCTGAAAAACACTCTTCCAGTCCAAAAGCTTCTTGATACAGAAAAAGAGCC
TGGATTTACAGAAACATATAGATCTGGTTTGAATTCCAGATCGAGTTTACAGTTGTGAAATCT
TGAAGGTATTACTTAACTTCACTACAGATTGTCTAGAAGACCTTTCTAGGAGTTATCTGATTC
TAGAAGGGTCTATACTTGTCCTTGTCTTTAAGCTATTTGACAACTCTACGTGTTGTAGAAAAC
TGATAATAATACAAATGATTGTTGTCCATGGAAAGGCAAATAAATTTTCTACAGTGAAAAAAA
AAAAAAA

FIGURE 462

```
MRSCLWRCRHLSQGVQWSLLLAVLVFFLFALPSFIKEPQTKPSRHQRTENIKERSLQSLAKPK
SQAPTRARRTTIYAEPAPENNALNTQTQPKAHTTGDRGKEANQAPPEEQDKVPHTAQRAAWKS
PEKEKTMVNTLSPRGQDAGMASGRTEAQSWKSQDTKTTQGNGGQTRKLTASRTVSEKHQGKAA
TTAKTLIPKSQHRMLAPTGAVSTRTRQKGVTTAVIPPKEKKPQATPPPAPFQSPTTQRNQRLK
AANFKSEPRWDFEEKYSFEIGGLQTTCPDSVKIKASKSLWLQKLFLPNLTLFLDSRHFNQSEW
DRLEHFAPPFGFMELNYSLVQKVVTRFPPVPQQQLLLASLPAGSLRCITCAVVGNGGILNNSH
MGQEIDSHDYVFRLSGALIKGYEQDVGTRTSFYGFTAFSLTQSLLILGNRGFKNVPLGKDVRY
LHFLEGTRDYEWLEALLMNQTVMSKNLFWFRHRPQEAFREALHMDRYLLLHPDFLRYMKNRFL
RSKTLDGAHWRIYRPTTGALLLLTALQLCDQVSAYGFITEGHERFSDHYYDTSWKRLIFYINH
DFKLEREVWKRLHDEGIIRLYQRPGPGTAKAKN
```

Important features:

Cytoplasmic Domain:
amino acids 1-10

Type II Transmembrane Domain:
amino acids 11-35

Lumenal catalytic Domain:
amino acids 36-600

Ribonucleotide Reductase small subunit Signature:
amino acids 481-496

N-glycosylation Sites:
amino acids 300-303, 311-314, 331-334, 375-378, 460-463

FIGURE 463

```
GGGGGAGCTAGGCCGGCGGCAGTGGTGGTGGCGGCGGCGCAAGGGTGAGGGCGGCCCCAGAAC
CCCAGGTAGGTAGAGCAAGAAGATGGTGTTTCTGCCCCTCAAATGGTCCCTTGCAACCATGTC
ATTTCTACTTTCCTCACTGTTGGCTCTCTTAACTGTGTCCACTCCTTCATGGTGTCAGAGCAC
TGAAGCATCTCCAAAACGTAGTGATGGGACACCATTTCCTTGGAATAAAATACGACTTCCTGA
GTACGTCATCCCAGTTCATTATGATCTCTTGATCCATGCAAACCTTACCACGCTGACCTTCTG
GGGAACCACGAAAGTAGAAATCACAGCCAGTCAGCCCACCAGCACCATCATCCTGCATAGTCA
CCACCTGCAGATATCTAGGGCCACCCTCAGGAAGGGAGCTGGAGAGAGGCTATCGGAAGAACC
CCTGCAGGTCCTGGAACACCCCCCTCAGGAGCAAATTGCACTGCTGGCTCCCGAGCCCCTCCT
TGTCGGGCTCCCGTACACAGTTGTCATTCACTATGCTGGCAATCTTTCGGAGACTTTCCACGG
ATTTTACAAAAGCACCTACAGAACCAAGGAAGGGGAACTGAGGATACTAGCATCAACACAATT
TGAACCCACTGCAGCTAGAATGGCCTTTCCCTGCTTTGATGAACCTGCCTTCAAAGCAAGTTT
CTCAATCAAAATTAGAAGAGAGCCAAGGCACCTAGCCATCTCCAATATGCCATTGGTGAAATC
TGTGACTGTTGCTGAAGGACTCATAGAAGACCATTTTGATGTCACTGTGAAGATGAGCACCTA
TCTGGTGGCCTTCATCATTTCAGATTTTTGAGTCTGTCAGCAAGATAACCAAGAGTGGAGTCAA
GGTTTCTGTTTATGCTGTGCCAGACAAGATAAATCAAGCAGATTATGCACTGGATGCTGCGGT
GACTCTTCTAGAATTTTATGAGGATTATTTCAGCATACCGTATCCCCTACCCAAACAAGATCT
TGCTGCTATTCCCGACTTTCAGTCTGGTGCTATGGAAAACTGGGGACTGACAACATATAGAGA
ATCTGCTCTGTTGTTTGATGCAGAAAAGTCTTCTGCATCAAGTAAGCTTGGCATCACAGTGAC
TGTGGCCCATGAACTGGCCCACCAGTGGTTTGGGAACCTGGTCACTATGGAATGGTGGAATGA
TCTTTGGCTAAATGAAGGATTTGCCAAATTTATGGAGTTTGTGTCTGTCAGTGTGACCCATCC
TGAACTGAAAGTTGGAGATTATTTCTTTGGCAAATGTTTTGACGCAATGGAGGTAGATGCTTT
AAATTCCTCACACCCTGTGTCTACACCTGTGGAAAATCCTGCTCAGATCCGGGAGATGTTTGA
TGATGTTTCTTATGATAAGGGAGCTTGTATTCTGAATATGCTAAGGGAGTATCTTAGCGCTGA
CGCATTTAAAAGTGGTATTGTACAGTATCTCCAGAAGCATAGCTATAAAAATACAAAAAACGA
GGACCTGTGGGATAGTATGGCAAGTATTTGCCCTACAGATGGTGTAAAAGGGATGGATGGCTT
TTGCTCTAGAAGTCAACATTCATCTTCATCCTCACATTGGCATCAGGAAGGGGTGGATGTGAA
AACCATGATGAACACTTGGACACTGCAGAGGGGTTTTCCCCTAATAACCATCACAGTGAGGGG
GAGGAATGTACACATGAAGCAAGAGCACTACATGAAGGGCTCTGACGGCGCCCCGGACACTGG
GTACCTGTGGCATGTTCCATTGACATTCATCACCAGCAAATCCAACATGGTCCATCGATTTTT
GCTAAAAACAAAAACAGATGTGCTCATCCTCCCAGAAGAGGTGGAATGGATCAAATTTAATGT
GGGCATGAATGGCTATTACATTGTGCATTACGAGGATGATGGATGGGACTCTTTGACTGGCCT
TTTAAAAGGAACACACACAGCAGTCAGCAGTAATGATCGGGCAAGTCTCATTAACAATGCATT
TCAGCTCGTCAGCATTGGGAAGCTGTCCATTGAAAAGGCCTTGGATTTATCCCTGTACTTGAA
ACATGAAACTGAAATTATGCCCGTGTTTCAAGGTTTGAATGAGCTGATTCCTATGTATAAGTT
AATGGAGAAAAGAGATATGAATGAAGTGGAAACTCAATTCAAGGCCTTCCTCATCAGGCTGCT
AAGGGACCTCATTGATAAGCAGACATGGACAGACGAGGGCTCAGTCTCAGAGCAAATGCTGCG
GAGTGAACTACTACTCCTCGCCTGTGTGCACAACTATCAGCCGTGCGTACAGAGGGCAGAAGG
CTATTTCAGAAAGTGGAAGGAATCCAATGGAAACTTGAGCCTGCCTGTCGACGTGACCTTGGC
AGTGTTTGCTGTGGGGCCCAGAGCACAGAAGGCTGGGATTTTCTTTATAGTAAATATCAGTT
TTCTTTGTCCAGTACTGAGAAAAGCCAAATTGAATTTGCCCTCTGCAGAACCCAAAATAAGGA
AAAGCTTCAATGGCTACTAGATGAAAGCTTTAAGGGAGATAAAATAAAAACTCAGGAGTTTCC
ACAAATTCTTACACTCATTGGCAGGAACCCAGTAGGATACCCACTGGCCTGGCAATTTCTGAG
GAAAAACTGGAACAAACTTGTACAAAAGTTTGAACTTGGCTCATCTTCCATAGCCCACATGGT
AATGGGTACAACAAATCAATTCTCCACAAGAACACGGCTTGAAGAGGTAAAAGGATTCTTCAG
CTCTTTGAAAGAAAATGGTTCTCAGCTCCGTTGTGTCCAACAGACAATTGAAACCATTGAAGA
AAACATCGGTTGGATGGATAAGAATTTTGATAAAATCAGAGTGTGGCTGCAAAGTGAAAAGCT
TGAACGTATGTAAAAATTCCTCCCTTGCCCGGTTCCTGTTATCTCTAATCACCAACATTTTGT
TGAGTGTATTTTCAAACTAGAGATGGCTGTTTTGGCTCCAACTGGAGATACTTTTTTCCCTTC
AACTCATTTTTGACTATCCCTGTGAAAGAATAGCTGTTAGTTTTCATGAATGGGCTTTTT
CATGAATGGGCTATCGCTACCATGTGTTTGTTCATCACAGGTGTTGCCCTGCAACGTAAACC
CAAGTGTTGGGTTCCCTGCCACAGAAGAATAAAGTACCTTATTCTTCTCAAAAAAAAAAAAAA
AAAAAAAAAAAA
```

FIGURE 464

MVFLPLKWSLATMSFLLSSLLALLTVSTPSWCQSTEASPKRSDGTPFPWNKIRLPEYVIPVHY
DLLIHANLTTLTFWGTTKVEITASQPTSTIILHSHHLQISRATLRKGAGERLSEEPLQVLEHP
PQEQIALLAPEPLLVGLPYTVVIHYAGNLSETFHGFYKSTYRTKEGELRILASTQFEPTAARM
AFPCFDEPAFKASFSIKIRREPRHLAISNMPLVKSVTVAEGLIEDHFDVTVKMSTYLVAFIIS
DFESVSKITKSGVKVSVYAVPDKINQADYALDAAVTLLEFYEDYFSIPYPLPKQDLAAIPDFQ
SGAMENWGLTTYRESALLFDAEKSSASSKLGITVTVAHELAHQWFGNLVTMEWWNDLWLNEGF
AKFMEFVSVSVTHPELKVGDYFFGKCFDAMEVDALNSSHPVSTPVENPAQIREMFDDVSYDKG
ACILNMLREYLSADAFKSGIVQYLQKHSYKNTKNEDLWDSMASICPTDGVKGMDGFCSRSQHS
SSSSHWHQEGVDVKTMMNTWTLQRGFPLITITVRGRNVHMKQEHYMKGSDGAPDTGYLWHVPL
TFITSKSNMVHRFLLKTKTDVLILPEEVEWIKFNVGMNGYYIVHYEDDGWDSLTGLLKGTHTA
VSSNDRASLINNAFQLVSIGKLSIEKALDLSLYLKHETEIMPVFQGLNELIPMYKLMEKRDMN
EVETQFKAFLIRLLRDLIDKQTWTDEGSVSEQMLRSELLLLACVHNYQPCVQRAEGYFRKWKE
SNGNLSLPVDVTLAVFAVGAQSTEGWDFLYSKYQFSLSSTEKSQIEFALCRTQNKEKLQWLLD
ESFKGDKIKTQEFPQILTLIGRNPVGYPLAWQFLRKNWNKLVQKFELGSSSIAHMVMGTTNQF
STRTRLEEVKGFFSSLKENGSQLRCVQQTIETIEENIGWMDKNFDKIRVWLQSEKLERM

Important features:

Signal peptide:
amino acids 1-34

N-glycosylation sites:
amino acids 70-74, 154-158, 414-418, 760-764, 901-905

Neutral zinc metallopeptidases, zinc-binding region signature:
amino acids 350-360

FIGURE 465

CAGCCACAGACGGGTCATGAGCGCGGTATTACTGCTGGCCCTCCTGGGGTTCATCCTCCCACT
GCCAGGAGTGCAGGCGCTGCTCTGCCAGTTTGGGACAGTTCAGCATGTGTGGAAGGTGTCCGA
CCTACCCCGGCAATGGACCCCTAAGAACACCAGCTGCGACAGCGGCTTGGGGTGCCAGGACAC
GTTGATGCTCATTGAGAGCGGACCCCAAGTGAGCCTGGTGCTCTCCAAGGGCTGCACGGAGGC
CAAGGACCAGGAGCCCCGCGTCACTGAGCACCGGATGGGCCCCGGCCTCTCCCTGATCTCCTA
CACCTTCGTGTGCCGCCAGGAGGACTTCTGCAACAACCTCGTTAACTCCCTCCCGCTTTGGGC
CCCACAGCCCCAGCAGACCCAGGATCCTTGAGGTGCCCAGTCTGCTTGTCTATGGAAGGCTG
TCTGGAGGGGACAACAGAAGAGATCTGCCCCAAGGGGACCACACACTGTTATGATGGCCTCCT
CAGGCTCAGGGGAGGAGGCATCTTCTCCAATCTGAGAGTCCAGGGATGCATGCCCCAGCCAGG
TTGCAACCTGCTCAATGGGACACAGGAAATTGGGCCCGTGGGTATGACTGAGAACTGCAATAG
GAAAGATTTTCTGACCTGTCATCGGGGACCACCATTATGACACACGGAAACTTGGCTCAAGA
ACCCACTGATTGGACCACATCGAATACCGAGATGTGCGAGGTGGGCAGGTGTGTCAGGAGAC
GCTGCTGCTCATAGATGTAGGACTCACATCAACCCTGGTGGGACAAAAGGCTGCAGCACTGT
TGGGGCTCAAAATTCCCAGAAGACCACCATCCACTCAGCCCCTCCTGGGGTGCTTGTGGCCTC
CTATACCCACTTCTGCTCCTCGGACCTGTGCAATAGTGCCAGCAGCAGCAGCGTTCTGCTGAA
CTCCCTCCCTCCTCAAGCTGCCCCTGTCCCAGGAGACCGGCAGTGTCCTACCTGTGTGCAGCC
CCTTGGAACCTGTTCAAGTGGCTCCCCCGAATGACCTGCCCCAGGGGCGCCACTCATTGTTA
TGATGGGTACATTCATCTCTCAGGAGGTGGGCTGTCCACCAAAATGAGCATTCAGGGCTGCGT
GGCCCAACCTTCCAGCTTCTTGTTGAACCACACCAGACAAATCGGGATCTTCTCTGCGCGTGA
GAAGCGTGATGTGCAGCCTCCTGCCTCTCAGCATGAGGGAGGTGGGGCTGAGGGCCTGGAGTC
TCTCACTTGGGGGGTGGGGCTGGCACTGGCCCCAGCGCTGTGGTGGGGAGTGGTTTGCCCTTC
CTGCTAACTCTATTACCCCCACGATTCTTCACCGCTGCTGACCACCCACACTCAACCTCCCTC
TGACCTCATAACCTAATGGCCTTGGACACCAGATTCTTTCCCATTCTGTCCATGAATCATCTT
CCCCACACACAATCATTCATATCTACTCACCTAACAGCAACACTGGGGAGAGCCTGGAGCATC
CGGACTTGCCCTATGGGAGAGGGGACGCTGGAGGAGTGGCTGCATGTATCTGATAATACAGAC
CCTGTCCTTTCA

FIGURE 466

MSAVLLLALLGFILPLPGVQALLCQFGTVQHVWKVSDLPRQWTPKNTSCDSGLGCQDTLMLIE
SGPQVSLVLSKGCTEAKDQEPRVTEHRMGPGLSLISYTFVCRQEDFCNNLVNSLPLWAPQPPA
DPGSLRCPVCLSMEGCLEGTTEEICPKGTTHCYDGLLRLRGGGIFSNLRVQGCMPQPGCNLLN
GTQEIGPVGMTENCNRKDFLTCHRGTTIMTHGNLAQEPTDWTTSNTEMCEVGQVCQETLLLID
VGLTSTLVGTKGCSTVGAQNSQKTTIHSAPPGVLVASYTHFCSSDLCNSASSSSVLLNSLPPQ
AAPVPGDRQCPTCVQPLGTCSSGSPRMTCPRGATHCYDGYIHLSGGGLSTKMSIQGCVAQPSS
FLLNHTRQIGIFSAREKRDVQPPASQHEGGGAEGLESLTWGVGLALAPALWWGVVCPSC

FIGURE 467

```
GAGGATTTGCCACAGCAGCGGATAGAGCAGGAGAGCACCACCGGAGCCCTTGAGACATCCTTG
AGAAGAGCCACAGCATAAGAGACTGCCCTGCTTGGTGTTTTGCAGGATGATGGTGGCCCTTCG
AGGAGCTTCTGCATTGCTGGTTCTGTTCCTTGCAGCTTTTCTGCCCCGCCGCAGTGTACCCA
GGACCCAGCCATGGTGCATTACATCTACCAGCGCTTTCGAGTCTTGGAGCAAGGGCTGGAAAA
ATGTACCCAAGCAACGAGGGCATACATTCAAGAATTCCAAGAGTTCTCAAAAAATATATCTGT
CATGCTGGGAAGATGTCAGACCTACACAAGTGAGTACAAGAGTGCAGTGGGTAACTTGGCACT
GAGAGTTGAACGTGCCCAACGGGAGATTGACTACATACAATACCTTCGAGAGGCTGACGAGTG
CATCGTATCAGAGGACAAGACACTGGCAGAAATGTTGCTCCAAGAAGCTGAAGAAGAGAAAAA
GATCCGGACTCTGCTGAATGCAAGCTGTGACAACATGCTGATGGGCATAAAGTCTTTGAAAAT
AGTGAAGAAGATGATGGACACACATGGCTCTTGGATGAAAGATGCTGTCTATAACTCTCCAAA
GGTGTACTTATTAATTGGATCCAGAAACAACACTGTTTGGGAATTTGCAAACATACGGGCATT
CATGGAGGATAACACCAAGCCAGCTCCCCGGAAGCAAATCCTAACACTTTCCTGGCAGGGAAC
AGGCCAAGTGATCTACAAAGGTTTTCTATTTTTTCATAACCAAGCAACTTCTAATGAGATAAT
CAAATATAACCTGCAGAAGAGGACTGTGGAAGATCGAATGCTGCTCCCAGGAGGGGTAGGCCG
AGCATTGGTTTACCAGCACTCCCCCTCAACTTACATTGACCTGGCTGTGGATGAGCATGGGCT
CTGGGCCATCCACTCTGGGCCAGGCACCCATAGCCATTTGGTTCTCACAAAGATTGAGCCGGG
CACACTGGGAGTGGAGCATTCATGGGATACCCCATGCAGAAGCCAGGATGCTGAAGCCTCATT
CCTCTTGTGTGGGTTCTCTATGTGGTCTACAGTACTGGGGGCCAGGGCCCTCATCGCATCAC
CTGCATCTATGATCCACTGGGCACTATCAGTGAGGAGGACTTGCCCAACTTGTTCTTCCCCAA
GAGACCAAGAAGTCACTCCATGATCCATTACAACCCCAGAGATAAGCAGCTCTATGCCTGGAA
TGAAGGAAACCAGATCATTTACAAACTCCAGACAAAGAGAAAGCTGCCTCTGAAGTAATGCAT
TACAGCTGTGAGAAAGAGCACTGTGGCTTTGGCAGCTGTTCTACAGGACAGTGAGGCTATAGC
CCCTTCACAATATAGTATCCCTCTAATCACACACAGGAAGAGTGTGTAGAAGTGGAAATACGT
ATGCCTCCTTTCCCAAATGTCACTGCCTTAGGTATCTTCCAAGAGCTTAGATGAGAGCATATC
ATCAGGAAAGTTTCAACAATGTCCATTACTCCCCCAAACCTCCTGGCTCTCAAGGATGACCAC
ATTCTGATACAGCCTACTTCAAGCCTTTTGTTTTACTGCTCCCAGCATTTACTGTAACTCTG
CCATCTTCCCTCCCACAATTAGAGTTGTATGCCAGCCCCTAATATTCACCACTGGCTTTTCTC
TCCCCTGGCCTTTGCTGAAGCTCTTCCCTCTTTTTCAAATGTCTATTGATATTCTCCCATTTT
CACTGCCCAACTAAAATACTATTAATATTTCTTTCTTTTCTTTTCTTTTTTTGAGACAAGGT
CTCACTATGTTGCCCAGGCTGGTCTCAAACTCCAGAGCTCAAGAGATCCTCCTGCCTCAGCCT
CCTAAGTACCTGGGATTACAGGCATGTGCCACCACACCTGGCTTAAAATACTATTTCTTATTG
AGGTTTAACCTCTATTTCCCCTAGCCCTGTCCTTCCACTAAGCTTGGTAGATGTAATAATAAA
GTGAAAATATTAACATTTGAATATCGCTTTCCAGGTGTGGAGTGTTTGCACATCATTGAATTC
TCGTTTCACCTTTGTGAAACATGCACAAGTCTTTACAGCTGTCATTCTAGAGTTTAGGTGAGT
AACACAATTACAAAGTGAAAGATACAGCTAGAAAATACTACAAATCCCATAGTTTTTCCATTG
CCCAAGGAAGCATCAAATACGTATGTTTGTTCACCTACTCTTATAGTCAATGCGTTCATCGTT
TCAGCCTAAAAATAATAGTCTGTCCCTTTAGCCAGTTTTCATGTCTGCACAAGACCTTTCAAT
AGGCCTTTCAAATGATAATTCCTCCAGAAACCAGTCTAAGGGTGAGGACCCCAACTCTAGCC
TCCTCTTGTCTTGCTGTCCTCTGTTTCTCTCTTTCTGCTTTAAATTCAATAAAAGTGACACTG
AGCAAAAAAAAAAAAAAA
```

FIGURE 468

MMVALRGASALLVLFLAAFLPPPQCTQDPAMVHYIYQRFRVLEQGLEKCTQATRAYIQEFQEF
SKNISVMLGRCQTYTSEYKSAVGNLALRVERAQREIDYIQYLREADECIVSEDKTLAEMLLQE
AEEEKKIRTLLNASCDNMLMGIKSLKIVKKMMDTHGSWMKDAVYNSPKVYLLIGSRNNTVWEF
ANIRAFMEDNTKPAPRKQILTLSWQGTGQVIYKGFLFFHNQATSNEIIKYNLQKRTVEDRMLL
PGGVGRALVYQHSPSTYIDLAVDEHGLWAIHSGPGTHSHLVLTKIEPGTLGVEHSWDTPCRSQ
DAEASFLLCGVLYVVYSTGGQGPHRITCIYDPLGTISEEDLPNLFFPKRPRSHSMIHYNPRDK
QLYAWNEGNQIIYKLQTKRKLPLK

FIGURE 469

TGGCCTCCCCAGCTTGCCAGGCACAAGGCTGAGCGGGAGGAAGCGAGAGGCATCTAAGCAGGC
AGTGTTTTGCCTTCACCCCAAGTGACCATGAGAGGTGCCACGCGAGTCTCAATCATGCTCCTC
CTAGTAACTGTGTCTGACTGTGCTGTGATCACAGGGGCCTGTGAGCGGGATGTCCAGTGTGGG
GCAGGCACCTGCTGTGCCATCAGCCTGTGGCTTCGAGGGCTGCGGATGTGCACCCGCTGGGG
CGGGAAGGCGAGGAGTGCCACCCCGGCAGCCACAAGGTCCCCTTCTTCAGGAAACGCAAGCAC
CACACCTGTCCTTGCTTGCCCAACCTGCTGTGCTCCAGGTTCCCGGACGGCAGGTACCGCTGC
TCCATGGACTTGAAGAACATCAATTTTTAGGCGCTTGCCTGGTCTCAGGATACCCACCATCCT
TTTCCTGAGCACAGCCTGGATTTTTATTTCTGCCATGAAACCCAGCTCCCATGACTCTCCCAG
TCCCTACACTGACTACCCTGATCTCTCTTGTCTAGTACGCACATATGCACACAGGCAGACATA
CCTCCCATCATGACATGGTCCCCAGGCTGGCCTGAGGATGTCACAGCTTGAGGCTGTGGTGTG
AAAGGTGGCCAGCCTGGTTCTCTTCCCTGCTCAGGCTGCCAGAGAGGTGGTAAATGGCAGAAA
GGACATTCCCCCTCCCCTCCCCAGGTGACCTGCTCTCTTTCCTGGGCCCTGCCCCTCTCCCCA
CATGTATCCCTCGGTCTGAATTAGACATTCCTGGGCACAGGCTCTTGGGTGCATTGCTCAGAG
TCCCAGGTCCTGGCCTGACCCTCAGGCCCTTCACGTGAGGTCTGTGAGGACCAATTTGTGGGT
AGTTCATCTTCCCTCGATTGGTTAACTCCTTAGTTTCAGACCACAGACTCAAGATTGGCTCTT
CCCAGAGGGCAGCAGACAGTCACCCCAAGGCAGGTGTAGGGAGCCCAGGGAGGCCAATCAGCC
CCCTGAAGACTCTGGTCCCAGTCAGCCTGTGGCTTGTGGCCTGTGACCTGTGACCTTCTGCCA
GAATTGTCATGCCTCTGAGGCCCCTCTTACCACACTTTACCAGTTAACCACTGAAGCCCCCA
ATTCCCACAGCTTTTCCATTAAAATGCAAATGGTGGTGGTTCAATCTAATCTGATATTGACAT
ATTAGAAGGCAATTAGGGTGTTTCCTTAAACAACTCCTTTCCAAGGATCAGCCCTGAGAGCAG
GTTGGTGACTTTGAGGAGGGCAGTCCTCTGTCCAGATTGGGGTGGGAGCAAGGGACAGGGAGC
AGGGCAGGGGCTGAAAGGGGCACTGATTCAGACCAGGGAGGCAACTACACACCAACATGCTGG
CTTTAGAATAAAAGCACCAACTGAAAAAA

FIGURE 470

MRGATRVSIMLLLVTVSDCAVITGACERDVQCGAGTCCAISLWLRGLRMCTPLGREGEECHPG
SHKVPFFRKRKHHTCPCLPNLLCSRFPDGRYRCSMDLKNINF

Important feratures:

Signal peptide:

amino acids 1-19

Tyrosine kinase phosphorylation site:

amino acids 88-95

N-myristoylation sites:

amino acids 33-39, 35-41, 46-52

FIGURE 471

AGCGCCCGGGCGTCGGGGCGGTAAAAGGCCGGCAGAAGGGAGGCACTTGAGAAATGTCTTTCC
TCCAGGACCCAAGTTTCTTCACCATGGGGATGTGGTCCATTGGTGCAGGAGCCCTGGGGCTG
CTGCCTTGGCATTGCTGCTTGCCAACACAGACGTGTTTCTGTCCAAGCCCAGAAAGCGGCCC
TGGAGTACCTGGAGGATATAGACCTGAAAACACTGGAGAAGGAACCAAGGACTTTCAAAGCAA
AGGAGCTATGGGAAAAAATGGAGCTGTGATTATGGCCGTGCGGAGGCCAGGCTGTTTCCTCT
GTCGAGAGGAAGCTGCGGATCTGTCCTCCCTGAAAAGCATGTTGGACCAGCTGGGCGTCCCCC
TCTATGCAGTGGTAAAGGAGCACATCAGGACTGAAGTGAAGGATTTCCAGCCTTATTTCAAAG
GAGAAATCTTCCTGGATGAAAAGAAAAAGTTCTATGGTCCACAAAGGCGGAAGATGATGTTTA
TGGGATTTATCCGTCTGGGAGTGTGGTACAACTTCTTCCGAGCCTGGAACGGAGGCTTCTCTG
GAAACCTGGAAGGAGAAGGCTTCATCCTTGGGGAGTTTTCGTGGTGGGATCAGGAAAGCAGG
GCATTCTTCTTGAGCACCGAGAAAAAGAATTTGGAGACAAAGTAAACCTACTTTCTGTTCTGG
AAGCTGCTAAGATGATCAAACCACAGACTTTGGCCTCAGAGAAAAAATGATTGTGTGAAACTG
CCCAGCTCAGGGATAACCAGGGACATTCACCTGTGTTCATGGGATGTATTGTTTCCACTCGTG
TCCCTAAGGAGTGAGAAACCCATTTATACTCTACTCTCAGTATGGATTATTAATGTATTTTAA
TATTCTGTTTAGGCCCACTAAGGCAAAATAGCCCCAAAACAAGACTGACAAAAATCTGAAAAA
CTAATGAGGATTATTAAGCTAAAACCTGGGAATAGGAGGCTTAAAATTGACTGCCAGGCTGG
GTGCAGTGGCTCACACCTGTAATCCCAGCACTTTGGGAGGCCAAGGTGAGCAAGTCACTTGAG
GTCGGGAGTTCGAGACCAGCCTGAGCAACATGGCGAAACCCCGTCTCTACTAAAAATACAAAA
ATCACCCGGGTGTGGTGGCAGGCACCTGTAGTCCCAGCTACCCGGGAGGCTGAGGCAGGAGAA
TCACTTGAACCTGGGAGGTGGAGGTTGCGGTGAGCTGAGATCACACCACTGTATTCCAGCCTG
GGTGACTGAGACTCTAACTAA

FIGURE 472

MSFLQDPSFFTMGMWSIGAGALGAAALALLLANTDVFLSKPQKAALEYLEDIDLKTLEKEPRT
FKAKELWEKNGAVIMAVRRPGCFLCREEAADLSSLKSMLDQLGVPLYAVVKEHIRTEVKDFQP
YFKGEIFLDEKKKFYGPQRRKMMFMGFIRLGVWYNFFRAWNGGFSGNLEGEGFILGGVFVVGS
GKQGILLEHREKEFGDKVNLLSVLEAAKMIKPQTLASEKK

FIGURE 473

AATATATCATCTATTTATCATTAATCAATAATGTATTCTTTTATTCCAATAACATTTGGGTTT
TGGGATTTTAATTTTCAAACACAGCAGAATGACATTTTTTCTGTCACTATTATTATTGTTGGT
ATGTGAAGCTATTTGGAGATCCAATTCAGGAAGCAACACATTGGAGAATGGCTACTTTCTATC
AAGAAATAAAGAGAACCACAGTCAACCCACACAATCATCTTTAGAAGACAGTGTGACTCCTAC
CAAAGCTGTCAAAACCACAGGCAAGGGCATAGTTAAAGGACGGAATCTTGACTCAAGAGGGTT
AATTCTTGGTGCTGAAGCCTGGGGCAGGGGTGTAAAGAAAAACACTTAGATTCAATGATTGTA
AATTTAAGGCAAATACACATATTAGTATTACCTTAGTGTAATGTATCCCTGTCATATATACAA
TAAGGTGAAATTATAAGTACCCTATGCAGTTGGCTGGACAGTTCTAAATTGGACTTTATTAAT
TTTTAAAATCAGTAACTGATTTATCACTGGCTATGTGCTTAGATCTACAGGAGATCATATAAT
TTGATACAAATAAAAGAAAAGTGTTCTCTCCCCTTACAGAATTGACATTTTAAATGCGATACA
GTTAGAATAGGAAATATGACATTAGAAAGGAAGAATGACAGGGAGAAAGGAAAGAAGGGAAAA
TGTTGCCAAGGAAAAAAAAA

FIGURE 474

MTFFLSLLLLLVCEAIWRSNSGSNTLENGYFLSRNKENHSQPTQSSLEDSVTPTKAVKTTGKG
IVKGRNLDSRGLILGAEAWGRGVKKNT

FIGURE 475

GACAGTGGAGGGCAGTGGAGAGGACCGCGCTGTCCTGCTGTCACCAAGAGCTGGAGACACCAT
CTCCCACCGAGAGTCATGGCCCCATTGGCCCTGCACCTCCTCGTCCTCGTCCCCATCCTCCTC
AGCCTGGTGGCCTCCCAGGACTGGAAGGCTGAACGCAGCCAAGACCCCTTCGAGAAATGCATG
CAGGATCCTGACTATGAGCAGCTGCTCAAGGTGGTGACCTGGGGGCTCAATCGGACCCTGAAG
CCCCAGAGGGTGATTGTGGTTGGCGCTGGTGTGGCCGGGCTGGTGGCCGCCAAGGTGCTCAGC
GATGCTGGACACAAGGTCACCATCCTGGAGGCAGATAACAGGATCGGGGGCCGCATCTTCACC
TACCGGGACCAGAACACGGGCTGGATTGGGGAGCTGGGAGCCATGCGCATGCCCAGCTCTCAC
AGGATCCTCCACAAGCTCTGCCAGGGCCTGGGGCTCAACCTGACCAAGTTCACCCAGTACGAC
AAGAACACGTGGACGGAGGTGCACGAAGTGAAGCTGCGCAACTATGTGGTGGAGAAGGTGCCC
GAGAAGCTGGGCTACGCCTTGCGTCCCCAGGAAAAGGGCCACTCGCCCGAAGACATCTACCAG
ATGGCTCTCAACCAGGCCCTCAAAGACCTCAAGGCACTGGGCTGCAGAAAGGCGATGAAGAAG
TTTGAAAGGCACACGCTCTTGGAATATCTTCTCGGGGAGGGGAACCTGAGCCGGCCGGCCGTG
CAGCTTCTGGGAGACGTGATGTCCGAGGATGGCTTCTTCTATCTCAGCTTCGCCGAGGCCCTC
CGGGCCCACAGCTGCCTCAGCGACAGACTCCAGTACAGCCGCATCGTGGGTGGCTGGGACCTG
CTGCCGCGCGCGCTGCTGAGCTCGCTGTCCGGGCTTGTGCTGTTGAACGCGCCCGTGGTGGCG
ATGACCCAGGGACCGCACGATGTGCACGTGCAGATCGAGACCTCTCCCCCGGCGCGGAATCTG
AAGGTGCTGAAGGCCGACGTGGTGCTGCTGACGGCGAGCGGACCGGCGGTGAAGCGCATCACC
TTCTCGCCGCCGCTGCCCCGCCACATGCAGGAGGCGCTGCGGAGGCTGCACTACGTGCCGGCC
ACCAAGGTGTTCCTAAGCTTCCGCAGGCCCTTCTGGCGCGAGGAGCACATTGAAGGCGGCCAC
TCAAACACCGATCGCCCGTCGCGCATGATTTTCTACCCGCCGCCGCGCGAGGGCGCGCTGCTG
CTGGCCTCGTACACGTGGTCGGACGCGGCGGCAGCGTTCGCCGGCTTGAGCCGGGAAGAGGCG
TTGCGCTTGGCGCTCGACGACGTGGCGGCATTGCACGGGCCTGTCGTGCGCCAGCTCTGGGAC
GGCACCGGCGTCGTCAAGCGTTGGGCGGAGGACCAGCACAGCCAGGGTGGCTTTGTGGTACAG
CCGCCGGCGCTCTGGCAAACCGAAAAGGATGACTGGACGGTCCCTTATGGCCGCATCTACTTT
GCCGGCGAGCACACCGCCTACCCGCACGGCTGGGTGGAGACGGCGGTCAAGTCGGCGCTGCGC
GCCGCCATCAAGATCAACAGCCGGAAGGGGCCTGCATCGGACACGGCCAGCCCCGAGGGCAC
GCATCTGACATGGAGGGGCAGGGGCATGTGCATGGGGTGGCCAGCAGCCCCTCGCATGACCTG
GCAAAGGAAGAAGGCAGCCACCCTCCAGTCCAAGGCCAGTTATCTCTCCAAAACACGACCCAC
ACGAGGACCTCGCATTAAAGTATTTTCGGAAAAAAAAAAAAAAAAAAAAAAAAAAAAAAAAAA
AAAAAAAAAAAAAAAA

FIGURE 476

MAPLALHLLVLVPILLSLVASQDWKAERSQDPFEKCMQDPDYEQLLKVVTWGLNRTLKPQRVI
VVGAGVAGLVAAKVLSDAGHKVTILEADNRIGGRIFTYRDQNTGWIGELGAMRMPSSHRILHK
LCQGLGLNLTKFTQYDKNTWTEVHEVKLRNYVVEKVPEKLGYALRPQEKGHSPEDIYQMALNQ
ALKDLKALGCRKAMKKFERHTLLEYLLGEGNLSRPAVQLLGDVMSEDGFFYLSFAEALRAHSC
LSDRLQYSRIVGGWDLLPRALLSSLSGLVLLNAPVVAMTQGPHDVHVQIETSPPARNLKVLKA
DVVLLTASGPAVKRITFSPPLPRHMQEALRRLHYVPATKVFLSFRRPFWREEHIEGGHSNTDR
PSRMIFYPPPREGALLLASYTWSDAAAAFAGLSREEALRLALDDVAALHGPVVRQLWDGTGVV
KRWAEDQHSQGGFVVQPPALWQTEKDDWTVPYGRIYFAGEHTAYPHGWVETAVKSALRAAIKI
NSRKGPASDTASPEGHASDMEGQGHVHGVASSPSHDLAKEEGSHPPVQGQLSLQNTTHTRTSH

Important features:
Signal peptide:
amino acids 1-21

FIGURE 477

```
CTGACATGGCCTGACTCGGGACAGCTCAGAGCAGGGCAGAACTGGGGACACTCTGGGCCGGCCTTCTGCCTGCAT
GGACGCTCTGAAGCCACCCTGTCTCTGGAGGAACCACGAGCGAGGGAAGAAGGACAGGGACTCGTGTGGCAGGAA
GAACTCAGAGCCGGGAAGCCCCCATTCACTAGAAGCACTGAGAGATGCGGCCCCCTCGCAGGGTCTGAATTTCCT
GCTGCTGTTCACAAAGATGCTTTTTATCTTTAACTTTTTGTTTTCCCCACTTCCGACCCCGGCGTTGATCTGCAT
CCTGACATTTGGAGCTGCCATCTTCTTGTGGCTGATCACCAGACCTCAACCCGTCTTACCTCTTCTTGACCTGAA
CAATCAGTCTGTGGGAATTGAGGGAGGAGCACGGAAGGGGGTTTCCCAGAAGAACAATGACCTAACAAGTTGCTG
CTTCTCAGATGCCAAGACTATGTATGAGGTTTTCCAAAGAGGACTCGCTGTGTCTGACAATGGGCCCTGCTTGGG
ATATAGAAAACCAAACCAGCCCTACAGATGGCTATCTTACAAACAGGTGTCTGATAGAGCAGAGTACCTGGGTTC
CTGTCTCTTGCATAAAGGTTATAAATCATCACCAGACCAGTTTGTCGGCATCTTTGCTCAGAATAGGCCAGAGTG
GATCATCTCCGAATTGGCTTGTTACACGTACTCTATGGTAGCTGTACCTCTGTATGACACCTTGGGACCAGAAGC
CATCGTACATATTGTCAACAAGGCTGATATCGCCATGGTGATCTGTGACACACCCCAAAAGGCATTGGTGCTGAT
AGGGAATGTAGAGAAAGGCTTCACCCCGAGCCTGAAGGTGATCATCCTTATGGACCCCTTTGATGATGACCTGAA
GCAAAGAGGGGAGAAGAGTGGAATTGAGATCTTATCCCTATATGATGCTGAGAACCTAGGCAAAGAGCACTTCAG
AAAACCTGTGCCTCCTAGCCCAGAAGACCTGAGCGTCATCTGCTTCACCAGTGGGACCACAGGTGACCCCAAAGG
AGCCATGATAACCCATCAAAATATTGTTTCAAATGCTGCTGCCTTTCTCAAATGTGTGGAGCATGCTTATGAGCC
CACTCCTGATGATGTGGCCATATCCTACCTCCCTCTGGCTCATATGTTTGAGAGGATTGTACAGGCTGTTGTGTA
CAGCTGTGGAGCCAGAGTTGGATTCTTCCAAGGGGATATTCGGTTGCTGGCTGACGACATGAAGACTTTGAAGCC
CACATTGTTTCCCGCGGTGCCTCGACTCCTTAACAGGATCTACGATAAGGTACAAAATGAGGCCAAGACACCCTT
GAAGAAGTTCTTGTTGAAGCTGGCTGTTTCCAGTAAATTCAAAGAGCTTCAAAAGGGTATCATCAGGCATGATAG
TTTCTGGGACAAGCTCATCTTTGCAAAGATCCAGGACAGCCTGGGCGGAAGGGTTCGTGTAATTGTCACTGGAGC
TGCCCCCATGTCCACTTCAGTCATGACATTCTTCCGGGCAGCAATGGGATGTCAGGTGTATGAAGCTTATGGTCA
AACAGAATGCACAGGTGGCTGTACATTTACATTACCTGGGGACTGGACATCAGGTCACGTTGGGGTGCCCCTGGC
TTGCAATTACGTGAAGCTGGAAGATGTGGCTGACATGAACTACTTTACAGTGAATAATGAAGGAGAGGTCTGCAT
CAAGGGTACAAACGTGTTCAAAGGATACCTGAAGGACCCTGAGAAGACACAGGAAGCCCTGGACAGTGATGGCTG
GCTTCACACAGGAGACATTGGTCGCTGGCTCCCGAATGGAACTCTGAAGATCATCGACCGTAAAAAGAACATTTT
CAAGCTGGCCCAAGGAGAATACATTGCACCAGAGAAGATAGAAAATATCTACAACAGGAGTCAACCAGTGTTACA
AATTTTTGTACACGGGGAGAGCTTACGGTCATCCTTAGTAGGAGTGGTGGTTCCTGACACAGATGTACTTCCCTC
ATTTGCAGCCAAGCTTGGGGTGAAGGGCTCCTTTGAGGAACTGTGCCAAAACCAAGTTGTAAGGGAAGCCATTTT
AGAAGACTTGCAGAAAATTGGGAAAGAAAGTGGCCTTAAAACTTTTGAACAGGTCAAAGCCATTTTTCTTCATCC
AGAGCCATTTTCCATTGAAAATGGGCTCTTGACACCAACATTGAAAGCAAAGCGAGGAGAGCTTTCCAAATACTT
TCGGACCCAAATTGACAGCCTGTATGAGCACATCCAGGATTAGGATAAGGTACTTAAGTACCTGCCGGCCCACTG
TGCACTGCTTGTGAGAAAATGGATTAAAAACTATTCTTACATTTGTTTTGCCTTTCCTCCTATTTTTTTTTAACC
TGTTAAACTCTAAAGCCATAGCTTTTGTTTTATATTGAGACATATAATGTGTAAACTTAGTTCCCAAATAAATCA
ATCCTGTCTTTCCCATCTTCGATGTTGCTAATATTAAGGCTTCAGGGCTACTTTTATCAACATGCCTGTCTTCAA
GATCCCAGTTTATGTTCTGTGTCCTTCCTCATGATTTCCAACCTTAATACTATTAGTAACCACAAGTTCAAGGGT
CAAAGGGACCCTCTGTGCCTTCTTCTTTGTTTTGTGATAAACATAACTTGCCAACAGTCTCTATGCTTATTTACA
TCTTCTACTGTTCAAACTAAGAGATTTTTAAATTCTGAAAAACTGCTTACAATTCATGTTTTCTAGCCACTCCAC
AAACCACTAAAATTTTAGTTTTAGCCTATCACTCATGTCAATCATATCTATGAGACAAATGTCTCCGATGCTCTT
CTGCGTAAATTAAATTGTGTACTGAAGGGAAAAGTTTGATCATACCAAACATTTCCTAAACTCTCTAGTTAGATA
TCTGACTTGGGAGTATTAAAAATTGGGTCTATGACATACTGTCCAAAAGGAATGCTGTTCTTAAAGCATTATTTA
CAGTAGGAACTGGGGAGTAAATCTGTTCCCTACAGTTTGCTGCTGAGCTGGAAGCTGTGGGGGAAGGAGTTGACA
GGTGGGCCCAGTGAACTTTTCCAGTAAATGAAGCAAGCACTGAATAAAAACCTCCTGAACTGGGAACAAAGATCT
ACAGGCAAGCAAGATGCCCACACAACAGGCTTATTTTCTGTGAAGGAACCAACTGATCTCCCCCACCCTTGGATT
AGAGTTCCTGCTCTACCTTACCCACAGATAACACATGTTGTTTCTACTTGTAAATGTAAAGTCTTTAAAATAAAC
TATTACAGATAAAAAA
```

FIGURE 478

```
MDALKPPCLWRNHERGKKDRDSCGRKNSEPGSPHSLEALRDAAPSQGLNFLLLFTKMLFIFNF
LFSPLPTPALICILTFGAAIFLWLITRPQPVLPLLDLNNQSVGIEGGARKGVSQKNNDLTSCC
FSDAKTMYEVFQRGLAVSDNGPCLGYRKPNQPYRWLSYKQVSDRAEYLGSCLLHKGYKSSPDQ
FVGIFAQNRPEWIISELACYTYSMVAVPLYDTLGPEAIVHIVNKADIAMVICDTPQKALVLIG
NVEKGFTPSLKVIILMDPFDDDLKQRGEKSGIEILSLYDAENLGKEHFRKPVPPSPEDLSVIC
FTSGTTGDPKGAMITHQNIVSNAAAFLKCVEHAYEPTPDDVAISYLPLAHMFERIVQAVVYSC
GARVGFFQGDIRLLADDMKTLKPTLFPAVPRLLNRIYDKVQNEAKTPLKKFLLKLAVSSKFKE
LQKGIIRHDSFWDKLIFAKIQDSLGGRVRVIVTGAAPMSTSVMTFFRAAMGCQVYEAYGQTEC
TGGCTFTLPGDWTSGHVGVPLACNYVKLEDVADMNYFTVNNEGEVCIKGTNVFKGYLKDPEKT
QEALDSDGWLHTGDIGRWLPNGTLKIIDRKKNIFKLAQGEYIAPEKIENIYNRSQPVLQIFVH
GESLRSSLVGVVVPDTDVLPSFAAKLGVKGSFEELCQNQVVREAILEDLQKIGKESGLKTFEQ
VKAIFLHPEPFSIENGLLTPTLKAKRGELSKYFRTQIDSLYEHIQD
```

Important features:
Type II transmembrane domain:
amino acids 61-80

Putative AMP-binding domain signature.
amino acids 314-325

N-glycosylation site.
amino acids 102-105, 588-591 and 619-622

FIGURE 479

```
GGAGGCGGAGGCCGCGGCGAGCCGGGCCGAGCAGTGAGGGCCCTAGCGGGGCCCGAGCGGGGC
CCGGGGCCCCTAAGCCATTCCTGAAGTCATGGGCTGGCCAGGACATTGGTGACCCGCCAATCC
GGTATGGACGACTGGAAGCCCAGCCCCCTCATCAAGCCCTTTGGGGCTCGGAAGAAGCGGAGC
TGGTACCTTACCTGGAAGTATAAACTGACAAACCAGCGGGCCCTGCGGAGATTCTGTCAGACA
GGGGCCGTGCTTTTCCTGCTGGTGACTGTCATTGTCAATATCAAGTTGATCCTGGACACTCGG
CGAGCCATCAGTGAAGCCAATGAAGACCCAGAGCCAGAGCAAGACTATGATGAGGCCCTAGGC
CGCCTGGAGCCCCACGGCGCAGAGGCAGTGGTCCCCGGCGGGTCCTGGACGTAGAGGTGTAT
TCAAGTCGCAGCAAAGTATATGTGGCAGTGGATGGCACCACGGTGCTGGAGGATGAGGCCCGG
GAGCAGGGCCGGGCATCCATGTCATTGTCCTCAACCAGGCCACGGGCCACGTGATGGCAAAA
CGTGTGTTTGACACGTACTCACCTCATGAGGATGAGGCCATGGTGCTATTCCTCAACATGGTA
GCGCCCGGCCGAGTGCTCATCTGCACTGTCAAGGATGAGGGCTCCTTCCACCTCAAGGACACA
GCCAAGGCTCTGCTGAGGAGCCTGGGCAGCCAGGCTGGCCCTGCCCTGGGCTGGAGGGACACA
TGGGCCTTCGTGGGACGAAAAGGAGGTCCTGTCTTCGGGGAGAAACATTCTAAGTCACCTGCC
CTCTCTTCCTGGGGGACCCAGTCCTGCTGAAGACAGATGTGCCATTGAGCTCAGCAGAAGAG
GCAGAGTGCCACTGGGCAGACACAGAGCTGAACCGTCGCCGCCGGCGCTTCTGCAGCAAAGTT
GAGGGCTATGGAAGTGTATGCAGCTGCAAGGACCCCACACCCATCGAGTTCAGCCCTGACCCA
CTCCCAGACAACAAGGTCCTCAATGTGCCTGTGGCTGTCATTGCAGGGAACCGACCCAATTAC
CTGTACAGGATGCTGCGCTCTCTGCTTTCAGCCCAGGGGGTGTCTCCTCAGATGATAACAGTT
TTCATTGACGGCTACTATGAGGAACCCATGGATGTGGTGGCACTGTTTGGTCTGAGGGCATC
CAGCATACTCCCATCAGCATCAAGAATGCCCGCGTGTCTCAGCACTACAAGGCCAGCCTCACT
GCCACTTTCAACCTGTTTCCGGAGGCCAAGTTTGCTGTGGTTCTGGAAGAGGACCTGGACATT
GCTGTGGATTTTTTTCAGTTTCCTGAGCCAATCCATCCACCTACTGGAGGAGGATGACAGCCTG
TACTGCATCTCTGCCTGGAATGACCAGGGGTATGAACACACGGCTGAGGACCCAGCACTACTG
TACCGTGTGGAGACCATGCCTGGGCTGGGCTGGGTGCTCAGGAGGTCCTTGTACAAGGAGGAG
CTTGAGCCCAAGTGGCCTACACCGGAAAAGCTCTGGGATTGGGACATGTGGATGCGGATGCCT
GAACAACGCCGGGGCCGAGAGTGCATCATCCCTGACGTTTCCCGATCCTACCACTTTGGCATC
GTCGGCCTCAACATGAATGGCTACTTTCACGAGGCCTACTTCAAGAAGCACAAGTTCAACACG
GTTCCAGGTGTCCAGCTCAGGAATGTGGACAGTCTGAAGAAAGAAGCTTATGAAGTGGAAGTT
CACAGGCTGCTCAGTGAGGCTGAGGTTCTGGACCACAGCAAGAACCCTTGTGAAGACTCTTTC
CTGCCAGACACAGAGGGCCACACCTACGTGGCCTTTATTCGAATGGAGAAAGATGATGACTTC
ACCACCTGGACCCAGCTTGCCAAGTGCCTCCATATCTGGGACCTGGATGTGCGTGGCAACCAT
CGGGGCCTGTGGAGATTGTTTCGGAAGAAGAACCACTTCCTGGTGGTGGGGGTCCCGGCTTCC
CCCTACTCAGTGAAGAAGCCACCCTCAGTCACCCCAATTTTCCTGGAGCCACCCCCAAAGGAG
GAGGGAGCCCCAGGAGCCCCAGAACAGACATGAGACCTCCTCCAGGACCCTGCGGGCTGGGT
ACTGTGTACCCCCAGGCTGGCTAGCCCTTCCCTCCATCCTGTAGGATTTTGTAGATGCTGGTA
GGGGCTGGGGCTACCTTGTTTTTAACATGAGACTTAATTACTAACTCCAAGGGGAGGGTTCCC
CTGCTCCAACACCCCGTTCCTGAGTTAAAAGTCTATTTATTTACTTCCTTGTTGGAGAAGGGC
AGGAGAGTACCTGGGAATCATTACGATCCCTAGCAGCTCATCCTGCCCTTTGAATACCCTCAC
TTTCCAGGCCTGGCTCAGAATCTAACCTATTTATTGACTGTCCTGAGGGCCTTGAAAACAGGC
CGAACCTGGAGGGCCTGGATTTCTTTTTGGGCTGGAATGCTGCCCTGAGGGTGGGGCTGGCTC
TTACTCAGGAAACTGCTGTGCCCAACCCATGGACAGGCCCAGCTGGGGCCCACATGCTGACAC
AGACTCACTCAGAGACCCTTAGACACTGGACCAGGCCTCCTCTCAGCCTTCTCTTTGTCCAGA
TTTCCAAAGCTGGATAAGTTGGTCATTGATTAAAAAGGAGAAGCCCTCTGGGAAAAAAAAAA
AAAAAAAAAAAAAAAA
```

FIGURE 480

MDDWKPSPLIKPFGARKKRSWYLTWKYKLTNQRALRRFCQTGAVLFLLVTVIVNIKLILDTRR
AISEANEDPEPEQDYDEALGRLEPPRRRGSGPRRVLDVEVYSSRSKVYVAVDGTTVLEDEARE
QGRGIHVIVLNQATGHVMAKRVFDTYSPHEDEAMVLFLNMVAPGRVLICTVKDEGSFHLKDTA
KALLRSLGSQAGPALGWRDTWAFVGRKGGPVFGEKHSKSPALSSWGDPVLLKTDVPLSSAEEA
ECHWADTELNRRRRRFCSKVEGYGSVCSCKDPTPIEFSPDPLPDNKVLNVPVAVIAGNRPNYL
YRMLRSLLSAQGVSPQMITVFIDGYYEEPMDVVALFGLRGIQHTPISIKNARVSQHYKASLTA
TFNLFPEAKFAVVLEEDLDIAVDFFSFLSQSIHLLEEDDSLYCISAWNDQGYEHTAEDPALLY
RVETMPGLGWVLRRSLYKEELEPKWPTPEKLWDWDMWMRMPEQRRGRECIIPDVSRSYHFGIV
GLNMNGYPHEAYFKKHKFNTVPGVQLRNVDSLKKEAYEVEVHRLLSEAEVLDHSKNPCEDSFL
PDTEGHTYVAFIRMEKDDDFTTWTQLAKCLHIWDLDVRGNHRGLWRLFRKKNHFLVVGVPASP
YSVKKPPSVTPIFLEPPPKEEGAPGAPEQT

Important features:

Transmembrane domain:

amino acids 38-55

Homologous region to Mouse GNT1 amino acids 229-660

FIGURE 481

GAAAGAATGTTGTGGCTGCTCTTTTTTCTGGTGACTGCCATTCATGCTGAACTCTGTCAACCA
GGTGCAGAAAATGCTTTTAAAGTGAGACTTAGTATCAGAACAGCTCTGGGAGATAAAGCATAT
GCCTGGGATACCAATGAAGAATACCTCTTCAAAGCGATGGTAGCTTTCTCCATGAGAAAGTT
CCCAACAGAGAAGCAACAGAAATTTCCCATGTCCTACTTTGCAATGTAACCCAGAGGGTATCA
TTCTGGTTTGTGGTTACAGACCCTTCAAAAAATCACACCCTTCCTGCTGTTGAGGTGCAATCA
GCCATAAGAATGAACAAGAACCGGATCAACAATGCCTTCTTTCTAAATGACCAAACTCTGGAA
TTTTTAAAAATCCCTTCCACACTTGCACCACCCATGGACCCATCTGTGCCCATCTGGATTATT
ATATTTGGTGTGATATTTTGCATCATCATAGTTGCAATTGCACTACTGATTTATCAGGGATC
TGGCAACGTAGAAGAAAGAACAAAGAACCATCTGAAGTGGATGACGCTGAAGATAAGTGTGAA
ACATGATCACAATTGAAAATGGCATCCCCTCTGATCCCCTGGACATGAAGGGGGGCATATTA
ATGATGCCTTCATGACAGAGGATGAGAGGCTCACCCCTCTCTGAAGGGCTGTTGTTCTGCTTC
CTCAAGAAATTAAACATTTGTTTCTGTGTGACTGCTGAGCATCCTGAAATACCAAGAGCAGAT
CATATATTTTGTTTCACCATTCTTCTTTTGTAATAAATTTTGAATGTGCTTGAAAGTGAAAAG
CAATCAATTATACCCACCAACACCACTGAAATCATAAGCTATTCACGACTCAAAATATTCTAA
AATATTTTTCTGACAGTATAGTGTATAAATGTGGTCATGTGGTATTTGTAGTTATTGATTTAA
GCATTTTAGAAATAAGATCAGGCATATGTATATATTTTCACACTTCAAAGACCTAAGGAAAA
ATAAATTTTCCAGTGGAGAATACATATAATATGGTGTAGAAATCATTGAAAATGGATCCTTTT
TGACGATCACTTATATCACTCTGTATATGACTAAGTAAACAAAAGTGAGAAGTAATTATTGTA
AATGGATGGATAAAAATGGAATTACTCATATACAGGGTGGAATTTTATCCTGTTATCACACCA
ACAGTTGATTATATATTTTCTGAATATCAGCCCCTAATAGGACAATTCTATTTGTTGACCATT
TCTACAATTTGTAAAAGTCCAATCTGTGCTAACTTAATAAAGTAATAATCATCTCTTTTTAAA
AAAAAAAAAAAAAAAAAAAAAA

FIGURE 482

MLWLLFFLVTAIHAELCQPGAENAFKVRLSIRTALGDKAYAWDTNEEYLFKAMVAFSMRKVPN
REATEISHVLLCNVTQRVSFWFVVTDPSKNHTLPAVEVQSAIRMNKNRINNAFFLNDQTLEFL
KIPSTLAPPMDPSVPIWIIIFGVIFCIIIVAIALLILSGIWQRRRKNKEPSEVDDAEDKCENM
ITIENGIPSDPLDMKGGILMMPS

FIGURE 483

```
CGTCTCTGCGTTCGCCATGCGTCCCGGGGCGCCAGGGCCACTCTGGCCTCTGCCCTGGGGGC
CCTGGCTTGGGCCGTGGGCTTCGTGAGCTCCATGGGCTCGGGGAACCCCGCGCCCGGTGGTGT
TTGCTGGCTCCAGCAGGGCCAGGAGGCCACCTGCAGCCTGGTGCTCCAGACTGATGTCACCCG
GGCCGAGTGCTGTGCCTCCGGCAACATTGACACCGCCTGGTCCAACCTCACCCACCCGGGGAA
CAAGATCAACCTCCTCGGCTTCTTGGGCCTTGTCCACTGCCTTCCCTGCAAAGATTCGTGCGA
CGGCGTGGAGTGCGGCCCGGGCAAGGCGTGCCGCATGCTGGGGGGCCGCCCGCGCTGCGAGTG
CGCGCCCGACTGCTCGGGGCTCCCGGCGCGGCTGCAGGTCTGCGGCTCAGACGGCGCCACCTA
CCGCGACGAGTGCGAGCTGCGCGCCGCGCGCTGCCGCGGCCACCCGGACCTGAGCGTCATGTA
CCGGGGCCGCTGCCGCAAGTCCTGTGAGCACGTGGTGTGCCCGCGGCCACAGTCGTGCGTCGT
GGACCAGACGGGCAGCGCCCACTGCGTGGTGTGTCGAGCGGCGCCCTGCCCTGTGCCCTCCAG
CCCCGGCCAGGAGCTTTGCGGCAACAACAACGTCACCTACATCTCCTCGTGCCACATGCGCCA
GGCCACCTGCTTCCTGGGCCGCTCCATCGGCGTGCGCCACGCGGGCAGCTGCGCAGGCACCCC
TGAGGAGCCGCCAGGTGGTGAGTCTGCAGAAGAGGAAGAGAACTTCGTGTGAGCCTGCAGGAC
AGGCCTGGGCCTGGTGCCCGAGGCCCCCCATCATCCCTGTTATTTATTGCCACAGCAGAGTC
TAATTTATATGCCACGGACACTCCTTAGAGCCCGGATTCGGACCACTTGGGGATCCCAGAACC
TCCCTGACGATATCCTGGAAGGACTGAGGAAGGGAGGCCTGGGGGCCGGCTGGTGGGTGGGAT
AGACCTGCGTTCCGGACACTGAGCGCCTGATTTAGGGCCCTTCTCTAGGATGCCCCAGCCCCT
ACCCTAAGACCTATTGCCGGGGAGGATTCCACACTTCCGCTCCTTTGGGGATAAACCTATTAA
TTATTGCTACTATCAAGAGGGCTGGGCATTCTCTGCTGGTAATTCCTGAAGAGGCATGACTGC
TTTTCTCAGCCCCAAGCCTCTAGTCTGGGTGTGTACGGAGGGTCTAGCCTGGGTGTGTACGGA
GGGTCTAGCCTGGGTGAGTACGGAGGGTCTAGCCTGGGTGAGTACGGAGGGTCTAGCCTGGGT
GAGTACGGAGGGTCTAGCCTGGGTGTGTATGGAGGATCTAGCCTGGGTGAGTATGGAGGGTCT
AGCCTGGGTGAGTATGGAGGGTCTAGCCTGGGTGTGTATGGAGGGTCTAGCCTGGGTGAGTAT
GGAGGGTCTAGCCTGGGTGTGTATGGAGGGTCTAGCCTGGGTGAGTATGGAGGGTCTAGCCTG
GGTGTGTACGGAGGGTCTAGTCTGAGTGCGTGTGGGGACCTCAGAACACTGTGACCTTAGCCC
AGCAAGCCAGGCCCTTCATGAAGGCCAAGAAGGCTGCCACCATTCCCTGCCAGCCCAAGAACT
CCAGCTTCCCCACTGCCTCTGTGTGCCCCTTTGCGTCCTGTGAAGGCCATTGAGAAATGCCCA
GTGTGCCCCCTGGGAAAGGGCACGGCCTGTGCTCCTGACACGGGCTGTGCTTGGCCACAGAAC
CACCCAGCGTCTCCCCTGCTGCTGTCCACGTCAGTTCATGAGGCAACGTCGCGTGGTCTCAGA
CGTGGAGCAGCCAGCGGCAGCTCAGAGCAGGGCACTGTGTCCGGCGGAGCCAAGTCCACTCTG
GGGGAGCTCTGGCGGGGACCACGGGCCACTGCTCACCCACTGGCCCCGAGGGGGTGTAGACG
CCAAGACTCACGCATGTGTGACATCCGGAGTCCTGGAGCCGGGTGTCCCAGTGGCACCACTAG
GTGCCTGCTGCCTCCACAGTGGGGTTCACACCCAGGGCTCCTTGGTCCCCACAACCTGCCCC
GGCCAGGCCTGCAGACCCAGACTCCAGCCAGACCTGCCTCACCCACCAATGCAGCCGGGGCTG
GCGACACCAGCCAGGTGCTGGTCTTGGCCAGTTCTCCCACGACGGCTCACCCTCCCCTCCAT
CTGCGTTGATGCTCAGAATCGCCTACCTGTGCCTGCGTGTAAACCACAGCCTCAGACCAGCTA
TGGGGAGAGGACAACACGGAGGATATCCAGCTTCCCCGGTCTGGGGTGAGGAATGTGGGAGC
TTGGGCATCCTCCTCCAGCCTCCTCCAGCCCCAGGCAGTGCCTTACCTGTGGTGCCCAGAAA
AGTGCCCCTAGGTTGGTGGGTCTACAGGAGCCTCAGCCAGGCAGCCCACCCCACCCTGGGGCC
CTGCCTCACCAAGGAAATAAAGACTCAAGCCATAAAAAAAA
```

FIGURE 484

MRPGAPGPLWPLPWGALAWAVGFVSSMGSGNPAPGGVCWLQQGQEATCSLVLQTDVTRAECCA
SGNIDTAWSNLTHPGNKINLLGFLGLVHCLPCKDSCDGVECGPGKACRMLGGRPRCECAPDCS
GLPARLQVCGSDGATYRDECELRAARCRGHPDLSVMYRGRCRKSCEHVVCPRPQSCVVDQTGS
AHCVVCRAAPCPVPSSPGQELCGNNNVTYISSCHMRQATCFLGRSIGVRHAGSCAGTPEEPPG
GESAEEEENFV

Important features:

Signal peptide:

amino acids 1-20

N-glycosylation sites.

amino acids 73-77, 215-219

Osteonectin domain proteins.

amino acids 97-130, 169-202

FIGURE 485

```
GCTCGAGGCCGGCGGCGGCGGGAGAGCGACCCGGGCGGCCTCGTAGCGGGGCCCCGGATCCCC
GAGTGGCGGCCGGAGCCTCGAAAAGAGATTCTCAGCGCTGATTTTGAGATGATGGGCTTGGGA
ACGGGCGTCGCAGCATGAAGTCGCCGCCCCTCGTGCTGGCCGCCCTGGTGGCCTGCATCATC
GTCTTGGGCTTCAACTACTGGATTGCGAGCTCCCGGAGCGTGGACCTCCAGACACGGATCATG
GAGCTGGAAGGCAGGGTCCGCAGGGCGGCTGCAGAGAGAGGCGCCGTGGAGCTGAAGAAGAAC
GAGTTCCAGGGAGAGCTGGAGAAGCAGCGGGAGCAGCTTGACAAAATCCAGTCCAGCCACAAC
TTCCAGCTGGAGAGCGTCAACAAGCTGTACCAGGACGAAAGGCGGTTTTGGTGAATAACATC
ACCACAGGTGAGAGGCTCATCCGAGTGCTGCAAGACCAGTTAAAGACCCTGCAGAGGAATTAC
GGCAGGCTGCAGCAGGATGTCCTCCAGTTTCAGAAGAACCAGACCAACCTGGAGAGGAAGTTC
TCCTACGACCTGAGCCAGTGCATCAATCAGATGAAGGAGGTGAAGGAACAGTGTGAGGAGCGA
ATAGAAGAGGTCACCAAAAAGGGGAATGAAGCTGTAGCTTCCAGAGACCTGAGTGAAAACAAC
GACCAGAGACAGCAGCTCCAAGCCCTCAGTGAGCCTCAGCCCAGGCTGCAGGCAGCAGGCCTG
CCACACACAGAGGTGCCACAAGGGAAGGGAAACGTGCTTGGTAACAGCAAGTCCCAGACACCA
GCCCCCAGTTCCGAAGTGGTTTTGGATTCAAAGAGACAAGTTGAGAAAGAGGAAACCAATGAG
ATCCAGGTGGTGAATGAGGAGCCTCAGAGGGACAGGCTGCCGCAGGAGCCAGGCCGGGAGCAG
GTGGTGGAAGACAGACCTGTAGGTGGAAGAGGCTTCGGGGGAGCCGGAGAACTGGGCCAGACC
CCACAGGTGCAGGCTGCCCTGTCAGTGAGCCAGGAAAATCCAGAGATGGAGGGCCCTGAGCGA
GACCAGCTTGTCATCCCCGACGGACAGGAGGAGGAGCAGGAAGCTGCCGGGGAAGGGAGAAAC
CAGCAGAAACTGAGAGGAGAAGATGACTACAACATGGATGAAATGAAGCAGAATCTGAGACA
GACAAGCAAGCAGCCCTGGCAGGGAATGACAGAAACATAGATGTTTTTAATGTTGAAGATCAG
AAAAGAGACACCATAAATTTACTTGATCAGCGTGAAAAGCGGAATCATACACTCTGAATTGAA
CTGGAATCACATATTTCACAACAGGGCCGAAGAGATGACTATAAAATGTTCATGAGGGACTGA
ATACTGAAAACTGTGAAATGTACTAAATAAAATGTACATCTGA
```

FIGURE 486

MMGLGNGRRSMKSPPLVLAALVACIIVLGFNYWIASSRSVDLQTRIMELEGRVRRAAAERGAV
ELKKNEFQGELEKQREQLDKIQSSHNFQLESVNKLYQDEKAVLVNNITTGERLIRVLQDQLKT
LQRNYGRLQQDVLQFQKNQTNLERKFSYDLSQCINQMKEVKEQCEERIEEVTKKGNEAVASRD
LSENNDQRQQLQALSEPQPRLQAAGLPHTEVPQGKGNVLGNSKSQTPAPSSEVVLDSKRQVEK
EETNEIQVVNEEPQRDRLPQEPGREQVVEDRPVGGRGFGGAGELGQTPQVQAALSVSQENPEM
EGPERDQLVIPDGQEEEQEAAGEGRNQQKLRGEDDYNMDENEAESETDKQAALAGNDRNIDVF
NVEDQKRDTINLLDQREKRNHTL

Important features:
Signal peptide:
amino acids 1-29

FIGURE 487

AACTCAAACTCCTCTCTCTGGGAAAACGCGGTGCTTGCTCCTCCCGGAGTGGCCTTGGCAGGG
TGTTGGAGCCCTCGGTCTGCCCCGTCCGGTCTCTGGGGCCAAGGCTGGGTTTCCCTCATGTAT
GGCAAGAGCTCTACTCGTGCGGTGCTTCTTCTCCTTGGCATACAGCTCACAGCTCTTTGGCCT
ATAGCAGCTGTGGAAATTTATACCTCCCGGGTGCTGGAGGCTGTTAATGGGACAGATGCTCGG
TTAAAATGCACTTTCTCCAGCTTTGCCCCTGTGGGTGATGCTCTAACAGTGACCTGGAATTTT
CGTCCTCTAGACGGGGACCTGAGCAGTTTGTATTCTACTACCACATAGATCCCTTCCAACCC
ATGAGTGGGCGGTTTAAGGACCGGGTGTCTTGGGATGGGAATCCTGAGCGGTACGATGCCTCC
ATCCTTCTCTGGAAACTGCAGTTCGACGACAATGGGACATACACCTGCCAGGTGAAGAACCCA
CCTGATGTTGATGGGGTGATAGGGGAGATCCGGCTCAGCGTCGTGCACACTGTACGCTTCTCT
GAGATCCACTTCCTGGCTCTGGCCATTGGCTCTGCCTGTGCACTGATGATCATAATAGTAATT
GTAGTGGTCCTCTTCCAGCATTACCGGAAAAAGCGATGGGCCGAAAGAGCTCATAAAGTGGTG
GAGATAAAATCAAAAGAAGAGGAAAGGCTCAACCAAGAGAAAAAGGTCTCTGTTTATTTAGAA
GACACAGACTAACAATTTTAGATGGAAGCTGAGATGATTTCCAAGAACAAGAACCCTAGTATT
TCTTGAAGTTAATGGAAACTTTTCTTTGGCTTTTCCAGTTGTGACCCGTTTTCCAACCAGTTC
TGCAGCATATTAGATTCTAGACAAGCAACACCCCTCTGGAGCCAGCACAGTGCTCCTCCATAT
CACCAGTCATACACAGCCTCATTATTAAGGTCTTATTTAATTTCAGAGTGTAAATTTTTTCAA
GTGCTCATTAGGTTTTATAAACAAGAAGCTACATTTTTGCCCTTAAGACACTACTTACAGTGT
TATGACTTGTATACACATATATTGGTATCAAAGGGGATAAAAGCCAATTTGTCTGTTACATTT
CCTTTCACGTATTTCTTTTAGCAGCACTTCTGCTACTAAAGTTAATGTGTTTACTCTCTTTCC
TTCCCACATTCTCAATTAAAAGGTGAGCTAAGCCTCCTCGGTGTTTCTGATTAACAGTAAATC
CTAAATTCAAACTGTTAAATGACATTTTTATTTTTATGTCTCTCCTTAACTATGAGACACATC
TTGTTTTACTGAATTTCTTTCAATATTCCAGGTGATAGATTTTTGTCG

FIGURE 488

MYGKSSTRAVLLLLGIQLTALWPIAAVEIYTSRVLEAVNGTDARLKCTFSSFAPVGDALTVTW
NFRPLDGGPEQFVFYYHIDPFQPMSGRFKDRVSWDGNPERYDASILLWKLQFDDNGTYTCQVK
NPPDVDGVIGEIRLSVVHTVRFSEIHFLALAIGSACALMIIIVIVVVLFQHYRKKRWAERAHK
VVEIKSKEEERLNQEKKVSVYLEDTD

FIGURE 489

```
AAGCAACCAAACTGCAAGCTTTGGGAGTTGTTCGCTGTCCCTGCCCTGCTCTGCTAGGGAGAG
AACGCCAGAGGGAGGCGGCTGGCCCGGCGGCAGGCTCTCAGAACCGCTACCGGCGATGCTACT
GCTGTGGGTGTCGGTGGTCGCAGCCTTGGCGCTGGCGGTACTGGCCCCCGGAGCAGGGGAGCA
GAGGCGGAGAGCAGCCAAAGCGCCCAATGTGGTGCTGGTCGTGAGCGACTCCTTCGATGGAAG
GTTAACATTTCATCCAGGAAGTCAGGTAGTGAAACTTCCTTTTATCAACTTTATGAAGACACG
TGGGACTTCCTTTCTGAATGCCTACACAAACTCTCCAATTTGTTGCCCATCACGCGCAGCAAT
GTGGAGTGGCCTCTTCACTCACTTAACAGAATCTTGGAATAATTTTAAGGGTCTAGATCCAAA
TTATACAACATGGATGGATGTCATGGAGAGGCATGGCTACCGAACACAGAAATTTGGGAAACT
GGACTATACTTCAGGACATCACTCCATTAGTAATCGTGTGGAAGCGTGGACAAGAGATGTTGC
TTTCTTACTCAGACAAGAAGGCAGGCCCATGGTTAATCTTATCCGTAACAGGACTAAAGTCAG
AGTGATGGAAAGGGATTGGCAGAATACAGACAAAGCAGTAAACTGGTTAAGAAAGGAAGCAAT
TAATTACACTGAACCATTTGTTATTTACTTGGGATTAAATTTACCACACCCTTACCCTTCACC
ATCTTCTGGAGAAAATTTTGGATCTTCAACATTTCACACATCTCTTTATTGGCTTGAAAAAGT
GTCTCATGATGCCATCAAAATCCCAAAGTGGTCACCTTTGTCAGAAATGCACCCTGTAGATTA
TTACTCTTCTTATACAAAAAACTGCACTGGAAGATTTACAAAAAAGAAATTAAGAATATTAG
AGCATTTTATTATGCTATGTGTGCTGAGACAGATGCCATGCTTGGTGAATTATTTTGGCCCT
TCATCAATTAGATCTTCTTCAGAAAACTATTGTCATATACTCCTCAGACCATGGAGAGCTGGC
CATGGAACATCGACAGTTTTATAAAATGAGCATGTACGAGGCTAGTGCACATGTTCCGCTTTT
GATGATGGGACCAGGAATTAAAGCCGGCCTACAAGTATCAAATGTGGTTTCTCTTGTGGATAT
TTACCCTACCATGCTTGATATTGCTGGAATTCCTCTGCCTCAGAACCTGAGTGGATACTCTTT
GTTGCCGTTATCATCAGAAACATTTAAGAATGAACATAAAGTCAAAAACCTGCATCCACCCTG
GATTCTGAGTGAATTCCATGGATGTAATGTGAATGCCTCCACCTACATGCTTCGAACTAACCA
CTGGAAATATATAGCCTATTCGGATGGTGCATCAATATTGCCTCAACTCTTTGATCTTTCCTC
GGATCCAGATGAATTAACAAATGTTGCTGTAAAATTTCCAGAAATTACTTATTCTTTGGATCA
GAAGCTTCATTCCATTATAAACTACCCTAAAGTTTCTGCTTCTGTCCACCAGTATAATAAAGA
GCAGTTTATCAAGTGGAAACAAAGTATAGGACAGAATTATTCAAACGTTATAGCAAATCTTAG
GTGGCACCAAGACTGGCAGAAGGAACCAAGGAAGTATGAAAATGCAATTGATCAGTGGCTTAA
AACCCATATGAATCCAAGAGCAGTTTGAACAAAAAGTTTAAAAATAGTGTTCTAGAGATACAT
ATAAATATATTACAAGATCATAATTATGTATTTTAAATGAAACAGTTTTAATAATTACCAAGT
TTTGGCCGGGCACAGTGGCTCACACCTGTAATCCCAGGACTTTGGGAGGCTGAGGAAAGCAGA
TCACAAGGTCAAGAGATTGAGACCATCCTGGCCAACATGGTGAAACCCTGTCTCTACTAAAAA
TACAAAAATTAGCTGGGCGCGGTGGTGCACACCTATAGTCTCAGCTACTCAGAGGCTGAGGCA
GGAGGATCGCTTGAACCCGGGAGGCAGCAGTTGCAGTGAGCTGAGATTGCGCCACTGTACTCC
AGCCTGGCAACAGAGTGAGACTGTGTCGCAAAAAAATAAAATAAAATAATAATAATTACCAA
TTTTTCATTATTTTGTAAGAATGTAGTGTATTTTAAGATAAAATGCCAATGATTATAAAATCA
CATATTTTCAAAAATGGTTATTATTTAGGCCTTTGTACAATTTCTAACAATTTAGTGGAAGTA
TCAAAAGGATTGAAGCAAATACTGTAACAGTTATGTTCCTTTAAATAATAGAGAATATAAAAT
ATTGTAATAATATGTATCATAAAATAGTTGTATGTGAGCATTTGATGGTGAAAAAAAAAAAA
AAAAAAAAAAAAAAAAAAAAAAAAAAAAAAAAAAAAAAAAAAAAAAAAAAAAAAAAAAAAAA
AAAAAAAAAAAAAAAAAA
```

FIGURE 490

MLLLWVSVVAALALAVLAPGAGEQRRRAAKAPNVVLVVSDSFDGRLTFHPGSQVVKLPFINFM
KTRGTSFLNAYTNSPICCPSRAAMWSGLFTHLTESWNNFKGLDPNYTTWMDVMERHGYRTQKF
GKLDYTSGHHSISNRVEAWTRDVAFLLRQEGRPMVNLIRNRTKVRVMERDWQNTDKAVNWLRK
EAINYTEPFVIYLGLNLPHPYPSPSSGENFGSSTFHTSLYWLEKVSHDAIKIPKWSPLSEMHP
VDYYSSYTKNCTGRFTKKEIKNIRAFYYAMCAETDAMLGEIILALHQLDLLQKTIVIYSSDHG
ELAMEHRQFYKMSMYEASAHVPLLMMGPGIKAGLQVSNVVSLVDIYPTMLDIAGIPLPQNLSG
YSLLPLSSETFKNEHKVKNLHPPWILSEFHGCNVNASTYMLRTNHWKYIAYSDGASILPQLFD
LSSDPDELTNVAVKFPEITYSLDQKLHSIINYPKVSASVHQYNKEQFIKWKQSIGQNYSNVIA
NLRWHQDWQKEPRKYENAIDQWLKTHMNPRAV

Important features:
Signal peptide:
amino acids 1-15

N-glycosylation sites.
amino acids 108-111, 166-169, 193-196, 262-265, 375-378, 413-416,
498-501

Sulfatases proteins:
amino acids 286-315, 359-369, 78-97

FIGURE 491

GAGAGAAGTCAGCCTGGCAGAGAGACTCTGAAATGAGGGATTAGAGGTGTTCAAGGAGCAAGA
GCTTCAGCCTGAAGACAAGGGAGCAGTCCCTGAAGACGCTTCTACTGAGAGGTCTGCCATGGC
CTCTCTTGGCCTCCAACTTGTGGGCTACATCCTAGGCCTTCTGGGGCTTTTGGGCACACTGGT
TGCCATGCTGCTCCCCAGCTGGAAAACAAGTTCTTATGTCGGTGCCAGCATTGTGACAGCAGT
TGGCTTCTCCAAGGGCCTCTGGATGGAATGTGCCACACACAGCACAGGCATCACCCAGTGTGA
CATCTATAGCACCCTTCTGGGCCTGCCCGCTGACATCCAGGCTGCCCAGGCCATGATGGTGAC
ATCCAGTGCAATCTCCTCCCTGGCCTGCATTATCTCTGTGGTGGGCATGAGATGCACAGTCTT
CTGCCAGGAATCCCGAGCCAAAGACAGAGTGGCGGTAGCAGGTGGAGTCTTTTTCATCCTTGG
AGGCCTCCTGGGATTCATTCCTGTTGCCTGGAATCTTCATGGATCCTACGGGACTTCTACTC
ACCACTGGTGCCTGACAGCATGAAATTTGAGATTGGAGAGGCTCTTTACTTGGGCATTATTTC
TTCCCTGTTCTCCCTGATAGCTGGAATCATCCTCTGCTTTTCCTGCTCATCCCAGAGAAATCG
CTCCAACTACTACGATGCCTACCAAGCCCAACCTCTTGCCACAAGGAGCTCTCCAAGGCCTGG
TCAACCTCCCAAAGTCAAGAGTGAGTTCAATTCCTACAGCCTGACAGGGTATGTGTGAAGAAC
CAGGGGCCAGAGCTGGGGGGTGGCTGGGTCTGTGAAAAACAGTGGACAGCACCCCGAGGGCCA
CAGGTGAGGGACACTACCACTGGATCGTGTCAGAAGGTGCTGCTGAGGATAGACTGACTTTGG
CCATTGGATTGAGCAAAGGCAGAAATGGGGGCTAGTGTAACAGCATGCAGGTTGAATTGCCAA
GGATGCTCGCCATGCCAGCCTTTCTGTTTTCCTCACCTTGCTGCTCCCCTGCCCTAAGTCCCC
AACCCTCAACTTGAAACCCCATTCCCTTAAGCCAGGACTCAGAGGATCCCTTTGCCCTCTGGT
TTACCTGGGACTCCATCCCCAAACCCACTAATCACATCCCACTGACTGACCCTCTGTGATCAA
AGACCCTCTCTCTGGCTGAGGTTGGCTCTTAGCTCATTGCTGGGGATGGGAAGGAGAAGCAGT
GGCTTTTGTGGGCATTGCTCTAACCTACTTCTCAAGCTTCCCTCCAAAGAAACTGATTGGCCC
TGGAACCTCCATCCCACTCTTGTTATGACTCCACAGTGTCCAGACTAATTTGTGCATGAACTG
AAATAAAACCATCCTACGGTATCCAGGGAACAGAAAGCAGGATGCAGGATGGGAGGACAGGAA
GGCAGCCTGGGACATTTAAAAAAATA

FIGURE 492

MASLGLQLVGYILGLLGLLGTLVAMLLPSWKTSSYVGASIVTAVGFSKGLWMECATHSTGITQ
CDIYSTLLGLPADIQAAQAMMVTSSAISSLACIISVVGMRCTVFCQESRAKDRVAVAGGVFFI
LGGLLGFIPVAWNLHGILRDFYSPLVPDSMKFEIGEALYLGIISSLFSLIAGIILCFSCSSQR
NRSNYYDAYQAQPLATRSSPRPGQPPKVKSEFNSYSLTGYV

Important features:

Signal peptide:

amino acids 1-24

Transmembrane domains:

amino acids 82-102, 117-140, 163-182

N-glycosylation site.

amino acids 190-193

PMP-22 / EMP / MP20 family proteins.

amino acids 46-59

FIGURE 493

GCACTGCTGCTGTCCCATCAGCTGCTCTGAAGCTCCATGGTGCCCAGAATCTTCGCTCCTGCT
TATGTGTCAGTCTGTCTCCTCCTCTTGTGTCCAAGGGAAGTCATCGCTCCCGCTGGCTCAGAA
CCATGGCTGTGCCAGCCGGCACCCAGGTGTGGAGACAAGATCTACAACCCCTTGGAGCAGTGC
TGTTACAATGACGCCATCGTGTCCCTGAGCGAGACCCGCCAATGTGGTCCCCCTGCACCTTC
TGGCCCTGCTTTGAGCTCTGCTGTCTTGATTCCTTTGGCCTCACAAACGATTTTGTTGTGAAG
CTGAAGGTTCAGGGTGTGAATTCCCAGTGCCACTCATCTCCCATCTCCAGTAAATGTGAAAGC
AGAAGACGTTTTCCCTGAGAAGACATAGAAAGAAAATCAACTTTCACTAAGGCATCTCAGAAA
CATAGGCTAAGGTAATATGTGTACCAGTAGAGAAGCCTGAGGAATTTACAAAATGATGCAGCT
CCAAGCCATTGTATGGCCCATGTGGGAGACTGATGGGACATGGAGAATGACAGTAGATTATCA
GGAAATAAATAAAGTGGTTTTTCCAATGTACACACCTGTAAAA

FIGURE 494

MVPRIFAPAYVSVCLLLLCPREVIAPAGSEPWLCQPAPRCGDKIYNPLEQCCYNDAIVSLSET
RQCGPPCTFWPCFELCCLDSFGLTNDFVVKLKVQGVNSQCHSSPISSKCESRRRFP

Important features:

Signal peptide:

amino acids 1-25

FIGURE 495

CTCCACTGCAACCACCCAGAGCC<u>ATG</u>GCTCCCCGAGGCTGCATCGTAGCTGTCTTTGCCATTT

TCTGCATCTCCAGGCTCCTCTGCTCACACGGAGCCCCAGTGGCCCCCATGACTCCTTACCTGA

TGCTGTGCCAGCCACACAAGAGATGTGGGGACAAGTTCTACGACCCCCTGCAGCACTGTTGCT

ATGATGATGCCGTCGTGCCCTTGGCCAGGACCCAGACGTGTGGAAACTGCACCTTCAGAGTCT

GCTTTGAGCAGTGCTGCCCCTGGACCTTCATGGTGAAGCTGATAAACCAGAACTGCGACTCAG

CCCGGACCTCGGATGACAGGCTTTGTCGCAGTGTCAGC<u>TAA</u>TGGAACATCAGGGGAACGATGA

CTCCTGGATTCTCCTTCCTGGGTGGGCCTGGAGAAAGAGGCTGGTGTTACCTGAGATCTGGGA

TGCTGAGTGGCTGTTTGGGGGCCAGAGAAACACACACTCAACTGCCCACTTCATTCTGTGACC

TGTCTGAGGCCCACCCTGCAGCTGCCCTGAGGAGGCCCACAGGTCCCCTTCTAGAATTCTGGA

CAGCATGAGATGCGTGTGCTGATGGGGGCCCAGGGACTCTGAACCCTCCTGATGACCCCTATG

GCCAACATCAACCCGGCACCACCCCAAGGCTGGCTGGGGAACCCTTCACCCTTCTGTGAGATT

TTCCATCATCTCAAGTTCTCTTCTATCCAGGAGCAAAGCACAGGATCATAATAAATTTATGTA

CTTTATAAATGAAAA

FIGURE 496

MAPRGCIVAVFAIFCISRLLCSHGAPVAPMTPYLMLCQPHKRCGDKFYDPLQHCCYDDAVVPL
ARTQTCGNCTFRVCFEQCCPWTFMVKLINQNCDSARTSDDRLCRSVS

Important features:

Signal peptide:

amino acids 1-24

FIGURE 497

```
TGAAGGACTTTTCCAGGACCCAAGGCCACACACTGGAAGTCTTGCAGCTGAAGGGAGGCACTC
CTTGGCCTCCGCAGCCGATCACATGAAGGTGGTGCCAAGTCTCCTGCTCTCCGTCCTCCTGGC
ACAGGTGTGGCTGGTACCCGGCTTGGCCCCCAGTCCTCAGTCGCCAGAGACCCCAGCCCCTCA
GAACCAGACCAGCAGGGTAGTGCAGGCTCCCAGGGAGGAAGAGGAAGATGAGCAGGAGGCCAG
CGAGGAGAAGGCCGGTGAGGAAGAGAAAGCCTGGCTGATGGCCAGCAGGCAGCAGCTTGCCAA
GGAGACTTCAAACTTCGGATTCAGCCTGCTGCGAAAGATCTCCATGAGGCACGATGGCAACAT
GGTCTTCTCTCCATTTGGCATGTCCTTGGCCATGACAGGCTTGATGCTGGGGGCCACAGGGCC
GACTGAAACCCAGATCAAGAGAGGGCTCCACTTGCAGGCCCTGAAGCCCACCAAGCCCGGGCT
CCTGCCTTCCCTCTTTAAGGGACTCAGAGAGACCCTCTCCCGCAACCTGGAACTGGGCCTCTC
ACAGGGGAGTTTTGCCTTCATCCACAAGGATTTTGATGTCAAAGAGACTTTCTTCAATTTATC
CAAGAGGTATTTTGATACAGAGTGCGTGCCTATGAATTTTCGCAATGCCTCACAGGCCAAAAG
GCTCATGAATCATTACATTAACAAAGAGACTCGGGGGAAAATTCCCAAACTGTTTGATGAGAT
TAATCCTGAAACCAAATTAATTCTTGTGGATTACATCTTGTTCAAAGGGAAATGGTTGACCCC
ATTTGACCCTGTCTTCACCGAAGTCGACACTTTCCACCTGGACAAGTACAAGACCATTAAGGT
GCCCATGATGTACGGTGCAGGCAAGTTTGCCTCCACCTTTGACAAGAATTTTCGTTGTCATGT
CCTCAAACTGCCCTACCAAGGAAATGCCACCATGCTGGTGGTCCTCATGGAGAAATGGGTGA
CCACCTCGCCCTTGAAGACTACCTGACCACAGACTTGGTGGAGACATGGCTCAGAAACATGAA
AACCAGAAACATGGAAGTTTTCTTTCCGAAGTTCAAGCTAGATCAGAAGTATGAGATGCATGA
GCTGCTTAGGCAGATGGGAATCAGAAGAATCTTCTCACCCTTTGCTGACCTTAGTGAACTCTC
AGCTACTGGAAGAAATCTCCAAGTATCCAGGGTTTTACGAAGAACAGTGATTGAAGTTGATGA
AAGGGGCACTGAGGCAGTGGCAGGAATCTTGTCAGAAATTACTGCTTATTCCATGCCTCCTGT
CATCAAAGTGGACCGGCCATTTCATTTCATGATCTATGAAGAAACCTCTGGAATGCTTCTGTT
TCTGGGCAGGGTGGTGAATCCGACTCTCCTATAATTCAGGACATGCATAAGCACTTCGTGCTG
TAGTAGATGCTGAATCTGAGGTATCAAACACACACAGGATACCAGCAATGGATGGCAGGGGAG
AGTGTTCCTTTTGTTCTTAACTAGTTTAGGGTGTTCTCAAATAAATACAGTAGTCCCCACTTA
TCTGAGGGGATACATTCAAAGACCCCCAGCAGATGCCTGAAACGGTGGACAGTGCTGAACCT
TATATATATTTTTTCCTACACATACATACCTATGATAAAGTTTAATTTATAAATTAGGCACAG
TAAGAGATTAACAATAATAACAACATTAAGTAAAATGAGTTACTTGAACGCAAGCACTGCAAT
ACCATAACAGTCAAACTGATTATAGAGAAGGCTACTAAGTGACTCATGGGCGAGGAGCATAGA
CAGTGTGGAGACATTGGGCAAGGGGAGAATTCACATCCTGGGTGGGACAGAGCAGGACGATGC
AAGATTCCATCCCACTACTCAGAATGGCATGCTGCTTAAGACTTTTAGATTGTTTATTTCTGG
AATTTTTCATTTAATGTTTTGGACCATGGTTGACCATGGTTAACTGAGACTGCAGAAAGCAA
AACCATGGATAAGGGAGGACTACTACAAAAGCATTAAATTGATACATATTTTTTAAAAAAAAA
AAAAAAAAA
```

FIGURE 498

MKVVPSLLLSVLLAQVWLVPGLAPSPQSPETPAPQNQTSRVVQAPREEEEDEQEASEEKAGEE
EKAWLMASRQQLAKETSNFGFSLLRKISMRHDGNMVFSPFGMSLAMTGLMLGATGPTETQIKR
GLHLQALKPTKPGLLPSLFKGLRETLSRNLELGLSQGSFAFIHKDFDVKETFFNLSKRYFDTE
CVPMNFRNASQAKRLMNHYINKETRGKIPKLFDEINPETKLILVDYILFKGKWLTPFDPVFTE
VDTFHLDKYKTIKVPMMYGAGKFASTFDKNFRCHVLKLPYQGNATMLVVLMEKMGDHLALEDY
LTTDLVETWLRNMKTRNMEVFFPKFKLDQKYEMHELLRQMGIRRIFSPFADLSELSATGRNLQ
VSRVLRRTVIEVDERGTEAVAGILSEITAYSMPPVIKVDRPFHFMIYEETSGMLLFLGRVVNP
TLL

FIGURE 499

CTAGCCTGCGCCAAGGGGTAGTGAGACCGCGCGGCAACAGCTTGCGGCTGCGGGGAGCTCCCG
TGGGCGCTCCGCTGGCTGTGCAGGCGGCC<u>ATG</u>GATTCCTTGCGGAAAATGCTGATCTCAGTCG
CAATGCTGGGCGCAGGGGCTGGCGTGGGCTACGCGCTCCTCGTTATCGTGACCCCGGGAGAGC
GGCGGAAGCAGGAAATGCTAAAGGAGATGCCACTGCAGGACCCAAGGAGCAGGGAGGAGGCGG
CCAGGACCCAGCAGCTATTGCTGGCCACTCTGCAGGAGGCAGCGACCACGCAGGAGAACGTGG
CCTGGAGGAAGAACTGGATGGTTGGCGGCGAAGGCGGCGCCAGCGGGAGGTCACCG<u>TGA</u>GACC
GGACTTGCCTCCGTGGGCGCCGGACCTTGGCTTGGGCGCAGGAATCCGAGGCAGCCTTTCTCC
TTCGTGGGCCCAGCGGAGAGTCCGGACCGAGATACCATGCCAGGACTCTCCGGGGTCCTGTGA
GCTGCCGTCGGGTGAGCACGTTTCCCCCAAACCCTGGACTGACTGCTTTAAGGTCCGCAAGGC
GGGCCAGGGCCGAGACGCGAGTCGGATGTGGTGAACTGAAAGAACCAATAAAATCATGTTCCT
CCAAAAAAAAAAAAAAAAAAAAAAAAAAAAAAAAAAAAAAAAAAAAAAAAAAAAAAAAAAAA

FIGURE 500

MDSLRKMLISVAMLGAGAGVGYALLVIVTPGERRKQEMLKEMPLQDPRSREEAARTQQLLLAT
LQEAATTQENVAWRKNWMVGGEGGASGRSP

Important features:

Signal peptide:

amino acids 1-18

FIGURE 501

CAGGAGAGAAGGCACCGCCCCCACCCCGCCTCCAAAGCTAACCCTCGGGCTTGAGGGGAAGAG
GCTGACTGTACGTTCCTTCTACTCTGGCACCACTCTCCAGGCTGCCATGGGGCCCAGCACCCC
TCTCCTCATCTTGTTCCTTTTGTCATGGTCGGGACCCCTCCAAGGACAGCAGCACCACCTTGT
GGAGTACATGGAACGCCGACTAGCTGCTTTAGAGGAACGGCTGGCCCAGTGCCAGGACCAGAG
TAGTCGGCATGCTGCTGAGCTGCGGGACTTCAAGAACAAGATGCTGCCACTGCTGGAGGTGGC
AGAGAAGGAGCGGGAGGCACTCAGAACTGAGGCCGACACCATCTCCGGGAGAGTGGATCGTCT
GGAGCGGGAGGTAGACTATCTGGAGACCCAGAACCCAGCTCTGCCCTGTGTAGAGTTTGATGA
GAAGGTGACTGGAGGCCCTGGGACCAAAGGCAAGGGAAGAAGGAATGAGAAGTACGATATGGT
GACAGACTGTGGCTACACAATCTCTCAAGTGAGATCAATGAAGATTCTGAAGCGATTTGGTGG
CCCAGCTGGTCTATGGACCAAGGATCCACTGGGGCAAACAGAGAAGATCTACGTGTTAGATGG
GACACAGAATGACACAGCCTTTGTCTTCCCAAGGCTGCGTGACTTCACCCTTGCCATGGCTGC
CCGGAAAGCTTCCCGAGTCCGGGTGCCCTTCCCCTGGGTAGGCACAGGGCAGCTGGTATATGG
TGGCTTTCTTTATTTTGCTCGGAGGCCTCCTGGAAGACCTGGTGGAGGTGGTGAGATGGAGAA
CACTTGCAGCTAATCAAATTCCACCTGGCAAACCGAACAGTGGTGGACAGCTCAGTATTCCC
AGCAGAGGGGCTGATCCCCCCCTACGGCTTGACAGCAGACACCTACATCGACCTGGTAGCTGA
TGAGGAAGGTCTTTGGGCTGTCTATGCCACCCGGGAGGATGACAGGCACTTGTGTCTGGCCAA
GTTAGATCCACAGACACTGGACACAGAGCAGCAGTGGGACACACCATGTCCCAGAGAGAATGC
TGAGGCTGCCTTTGTCATCTGTGGGACCCTCTATGTCGTCTATAACACCCGTCCTGCCAGTCG
GGCCCGCATCCAGTGCTCCTTTGATGCCAGCGGCACCCTGACCCCTGAACGGGCAGCACTCCC
TTATTTTCCCCGCAGATATGGTGCCCATGCCAGCCTCCGCTATAACCCCCGAGAACGCCAGCT
CTATGCCTGGGATGATGGCTACCAGATTGTCTATAAGCTGGAGATGAGGAAGAAAGAGGAGGA
GGTTTTGAGGAGCTAGCCTTGTTTTTTGCATCTTTCTCACTCCCATACATTTATATTATATCCC
CACTAAATTTCTTGTTCCTCATTCTTCAAATGTGGGCCAGTTGTGGCTCAAATCCTCTATATT
TTTAGCCAATGGCAATCAAATTCTTTCAGCTCCTTTGTTTCATACGGAACTCCAGATCCTGAG
TAATCCTTTTAGAGCCCGAAGAGTCAAAACCCTCAATGTTCCCTCCTGCTCTCCTGCCCCATG
TCAACAAATTTCAGGCTAAGGATGCCCCAGACCCAGGGCTCTAACCTTGTATGCGGGCAGGCC
CAGGGAGCAGGCAGCAGTGTTCTTCCCCTCAGAGTGACTTGGGGAGGGAGAAATAGGAGGAGA
CGTCCAGCTCTGTCCTCTCTTCCTCACTCCTCCCTTCAGTGTCCTGAGGAACAGGACTTTCTC
CACATTGTTTTGTATTGCAACATTTTGCATTAAAAGGAAAATCCACAAAAAAAAAAAAAAAAA
AAAAAAAAAAAAAAAAAAAAAAAAAAAAAAAAAAAAAAAAAAAAAAAAAAAAAA

FIGURE 502

MGPSTPLLILFLLSWSGPLQGQQHHLVEYMERRLAALEERLAQCQDQSSRHAAELRDFKNKML
PLLEVAEKEREALRTEADTISGRVDRLEREVDYLETQNPALPCVEFDEKVTGGPGTKGKGRRN
EKYDMVTDCGYTISQVRSMKILKRFGGPAGLWTKDPLGQTEKIYVLDGTQNDTAFVFPRLRDF
TLAMAARKASRVRVPFPWVGTGQLVYGGFLYFARRPPGRPGGGGEMENTLQLIKFHLANRTVV
DSSVFPAEGLIPPYGLTADTYIDLVADEEGLWAVYATREDDRHLCLAKLDPQTLDTEQQWDTP
CPRENAEAAFVICGTLYVVYNTRPASRARIQCSFDASGTLTPERAALPYFPRRYGAHASLRYN
PRERQLYAWDDGYQIVYKLEMRKKEEEV

Important features:

Signal peptide:

amino acids 1-21

N-glycosylation sites.

amino acids 177-180, 248-251

FIGURE 503

TGCGGCGCAGTGTAGACCTGGGAGG<u>ATG</u>GGCGGCCTGCTGCTGGCTGCTTTTCTGGCTTTGGT
CTCGGTGCCCAGGGCCCAGGCCGTGTGGTTGGGAAGACTGGACCCTGAGCAGCTTCTTGGGCC
CTGGTACGTGCTTGCGGTGGCCTCCCGGGAAAAGGGCTTTGCCATGGAGAAGGACATGAAGAA
CGTCGTGGGGTGGTGGTGACCCTCACTCCAGAAAACAACCTGCGGACGCTGTCCTCTCAGCA
CGGGCTGGGAGGGTGTGACCAGAGTGTCATGGACCTGATAAAGCGAAACTCCGGATGGGTGTT
TGAGAATCCCTCAATAGGCGTGCTGGAGCTCTGGGTGCTGGCCACCAACTTCAGAGACTATGC
CATCATCTTCACTCAGCTGGAGTTCGGGGACGAGCCCTTCAACACCGTGGAGCTGTACAGTCT
GACGGAGACAGCCAGCCAGGAGGCCATGGGGCTCTTCACCAAGTGGAGCAGGAGCCTGGGCTT
CCTGTCACAG<u>TAG</u>CAGGCCCAGCTGCAGAAGGACCTCACCTGTGCTCACAAGATCCTTCTGTG
AGTGCTGCGTCCCCAGTAGGGATGGCGCCCACAGGGTCCTGTGACCTCGGCCAGTGTCCACCC
ACCTCGCTCAGCGGCTCCCGGGCCCAGCACCAGCTCAGAATAAAGCGATTCCACAGCA

FIGURE 504

MGGLLLAAFLALVSVPRAQAVWLGRLDPEQLLGPWYVLAVASREKGFAMEKDMKNVVGVVVTL
TPENNLRTLSSQHGLGGCDQSVMDLIKRNSGWVFENPSIGVLELWVLATNFRDYAIIFTQLEF
GDEPFNTVELYSLTETASQEAMGLFTKWSRSLGFLSQ

Important features:

Signal peptide:

amino acids 1-20

FIGURE 505

GTTCCGCAGATGCAGAGGTTGAGGTGGCTGCGGGACTGGAAGTCATCGGGCAGAGGTCTCACA
GCAGCCAAGGAACCTGGGGCCCGCTCCTCCCCCCTCCAGGCC<u>ATG</u>AGGATTCTGCAGTTAATC
CTGCTTGCTCTGGCAACAGGGCTTGTAGGGGGAGAGACCAGGATCATCAAGGGGTTCGAGTGC
AAGCCTCACTCCCAGCCCTGGCAGGCAGCCCTGTTCGAGAAGACGCGGCTACTCTGTGGGGCG
ACGCTCATCGCCCCAGATGGCTCCTGACAGCAGCCCACTGCCTCAAGCCCCGCTACATAGTT
CACCTGGGGCAGCACAACCTCCAGAAGGAGGAGGGCTGTGAGCAGACCCGGACAGCCACTGAG
TCCTTCCCCCACCCCGGCTTCAACAACAGCCTCCCCAACAAAGACCACCGCAATGACATCATG
CTGGTGAAGATGGCATCGCCAGTCTCCATCACCTGGGCTGTGCGACCCCTCACCCTCTCCTCA
CGCTGTGTCACTGCTGGCACCAGCTGCCTCATTTCCGGCTGGGGCAGCACGTCCAGCCCCCAG
TTACGCCTGCCTCACACCTTGCGATGCGCCAACATCACCATCATTGAGCACCAGAAGTGTGAG
AACGCCTACCCCGGCAACATCACAGACACCATGGTGTGTGCCAGCGTGCAGGAAGGGGGCAAG
GACTCCTGCCAGGGTGACTCCGGGGGCCCTCTGGTCTGTAACCAGTCTCTTCAAGGCATTATC
TCCTGGGGCCAGGATCCGTGTGCGATCACCCGAAAGCCTGGTGTCTACACGAAAGTCTGCAAA
TATGTGGACTGGATCCAGGAGACGATGAAGAACAAT<u>TAG</u>ACTGGACCCACCCACCACAGCCCA
TCACCCTCCATTTCCACTTGGTGTTTGGTTCCTGTTCACTCTGTTAATAAGAAACCCTAAGCC
AAGACCCTCTACGAACATTCTTTGGGCCTCCTGGACTACAGGAGATGCTGTCACTTAATAATC
AACCTGGGGTTCGAAATCAGTGAGACCTGGATTCAAATTCTGCCTTGAAATATTGTGACTCTG
GGAATGACAACACCTGGTTTGTTCTCTGTTGTATCCCCAGCCCCAAAGACAGCTCCTGGCCAT
ATATCAAGGTTTCAATAAATATTTGCTAAATGAAAAAAAAAAAAAAAAAAAAAAAAAAAAAA
AAAAAAA

FIGURE 506

MRILQLILLALATGLVGGETRIIKGFECKPHSQPWQAALFEKTRLLCGATLIAPRWLLTAAHC
LKPRYIVHLGQHNLQKEEGCEQTRTATESFPHPGFNNSLPNKDHRNDIMLVKMASPVSITWAV
RPLTLSSRCVTAGTSCLISGWGSTSSPQLRLPHTLRCANITIIEHQKCENAYPGNITDTMVCA
SVQEGGKDSCQGDSGGPLVCNQSLQGIISWGQDPCAITRKPGVYTKVCKYVDWIQETMKNN

Important features:

Signal peptide:

amino acids 1-18

Serine proteases, trypsin family, histidine active site.

amino acids 58-63

N-glycosylation sites.

amino acids 99-102, 165-168, 181-184, 210-213

Glycosaminoglycan attachment site.

amino acids 145-148

Kringle domain proteins.

amino acids 197-209, 47-64

Serine proteases, trypsin family, histidine protein amino acids 199-209, 47-63, 220-243

Apple domain proteins amino acids 222-249, 189-222

FIGURE 507

CTGGGATCAGCCACTGCAGCTCCCTGAGCACTCTCTACAGAGACGCGGACCCCAGACATGAGG
AGGCTCCTCCTGGTCACCAGCCTGGTGGTTGTGCTGCTGTGGGAGGCAGGTGCAGTCCCAGCA
CCCAAGGTCCCTATCAAGATGCAAGTCAAACACTGGCCCTCAGAGCAGGACCCAGAGAAGGCC
TGGGGCGCCCGTGTGGTGGAGCCTCCGGAGAAGGACGACCAGCTGGTGGTGCTGTTCCCTGTC
CAGAAGCCGAAACTCTTGACCACCGAGGAGAAGCCACGAGGTCAGGGCAGGGGCCCCATCCTT
CCAGGCACCAAGGCCTGGATGGAGACCGAGGACACCCTGGGCCGTGTCCTGAGTCCCGAGCCC
GACCATGACAGCCTGTACCACCCTCCGCCTGAGGAGGACCAGGGCGAGGAGAGGCCCCGGTTG
TGGGTGATGCCAAATCACCAGGTGCTCCTGGGACCGGAGGAAGACCAAGACCACATCTACCAC
CCCCAGTAGGGCTCCAGGGGCCATCACTGCCCCGCCCTGTCCCAAGCCCAGGCTGTTGGGA
CTGGGACCCTCCCTACCCTGCCCCAGCTAGACAAATAAACCCCAGCAGGCAAAAAAAAAAAA
AAAAAA

FIGURE 508

MRRLLLVTSLVVVLLWEAGAVPAPKVPIKMQVKHWPSEQDPEKAWGARVVEPPEKDDQLVVLF
PVQKPKLLTTEEKPRGQGRGPILPGTKAWMETEDTLGRVLSPEPDHDSLYHPPPEEDQGEERP
RLWVMPNHQVLLGPEEDQDHIYHPQ

FIGURE 509

GCGGAGCCGGCGCCGGCTGCGCAGAGGAGCCGCTCTCGCCGCCGCCACCTCGGCTGGGAGCCC
ACGAGGCTGCCGCATCCTGCCCTCGGAACA<u>ATG</u>GGACTCGGCGCGCGAGGTGCTTGGGCCGCG
CTGCTCCTGGGGACGCTGCAGGTGCTAGCGCTGCTGGGGGCCGCCCATGAAAGCGCAGCCATG
GCGGCATCTGCAAACATAGAGAATTCTGGGCTTCCACACAACTCCAGTGCTAACTCAACAGAG
ACTCTCCAACATGTGCCTTCTGACCATACAAATGAAACTTCCAACAGTACTGTGAAACCACCA
ACTTCAGTTGCCTCAGACTCCAGTAATACAACGGTCACCACCATGAAACCTACAGCGGCATCT
AATACAACAACACCAGGGATGGTCTCAACAAATATGACTTCTACCACCTTAAAGTCTACACCC
AAAACAACAAGTGTTTCACAGAACACATCTCAGATATCAACATCCACAATGACCGTAACCCAC
AATAGTTCAGTGACATCTGCTGCTTCATCAGTAACAATCACAACAACTATGCATTCTGAAGCA
AAGAAAGGATCAAAATTTGATACTGGGAGCTTTGTTGGTGGTATTGTATTAACGCTGGGAGTT
TTATCTATTCTTTACATTGGATGCAAAATGTATTACTCAAGAAGAGGCATTCGGTATCGAACC
ATAGATGAACATGATGCCATCATT<u>TAA</u>GGAAATCCATGGACCAAGGATGGAATACAGATTGAT
GCTGCCCTATCAATTAATTTTGGTTTATTAATAGTTTAAAACAATATTCTCTTTTTGAAAATA
GTATAAACAGGCCATGCATATAATGTACAGTGTATTACGTAAATATGTAAAGATTCTTCAAGG
TAACAAGGGTTTGGGTTTTGAAATAAACATCTGGATCTTATAGACCGTTCATACAATGGTTTT
AGCAAGTTCATAGTAAGACAAACAAGTCCTATCTTTTTTTTTGGCTGGGGTGGGGCATTGG
TCACATATGACCAGTAATTGAAAGACGTCATCACTGAAAGACAGAATGCCATCTGGGCATACA
AATAAGAAGTTTGTCACAGCACTCAGGATTTTGGGTATCTTTTGTAGCTCACATAAAGAACTT
CAGTGCTTTTCAGAGCTGGATATATCTTAATTACTAATGCCACACAGAAATTATACAATCAAA
CTAGATCTGAAGCATAATTTAAGAAAAACATCAACATTTTTTGTGCTTTAAACTGTAGTAGTT
GGTCTAGAAACAAAATACTCC

FIGURE 510

MGLGARGAWAALLLGTLQVLALLGAAHESAAMAASANIENSGLPHNSSANSTETLQHVPSDHT
NETSNSTVKPPTSVASDSSNTTVTTMKPTAASNTTTPGMVSTNMTSTTLKSTPKTTSVSQNTS
QISTSTMTVTHNSSVTSAASSVTITTTMHSEAKKGSKFDTGSFVGGIVLTLGVLSILYIGCKM
YYSRRGIRYRTIDEHDAII

FIGURE 511

```
GACTTTGCTTGAATGTTTACATTTTCTGCTCGCTGTCCTACATATCACAATATAGTGTTCACGTTTTGTTAAAAC
TTTGGGGTGTCAGGAGTTGAGCTTGCTCAGCAAGCCAGCATGGCTAGGATGAGCTTTGTTATAGCAGCTTGCCAA
TTGGTGCTGGGCCTACTAATGACTTCATTAACCGAGTCTTCCATACAGAATAGTGAGTGTCCACAACTTTGCGTA
TGTGAAATTCGTCCCTGGTTTACCCCACAGTCAACTTACAGAGAAGCCACCACTGTTGATTGCAATGACCTCCGC
TTAACAAGGATTCCCAGTAACCTCTCTAGTGACACACAAGTGCTTCTCTTACAGAGCAATAACATCGCGAAGACT
GTGGATGAGCTGCAGCAGCTTTTCAACTTGACTGAACTAGATTTCTCCCAAAACAACTTTACTAACATTAAGGAG
GTCGGGCTGGCAAACCTAACCCAGCTCACAACGCTGCATTTGGAGGAAAATCAGATTACCGAGATGACTGATTAC
TGTCTACAAGACCTCAGCAACCTTCAAGAACTCTACATCAACCACAACCAAATTAGCACTATTTCTGCTCATGCT
TTTGCAGGCTTAAAAAATCTATTAAGGCTCCACCTGAACTCCAACAAATTGAAAGTTATTGATAGTCGCTGGTTT
GATTCTACACCCAACCTGGAAATTCTCATGATCGGAGAAAACCCTGTGATTGGAATTCTGGATATGAACTTCAAA
CCCCTCGCAAATTTGAGAAGCTTAGTTTTGGCAGGAATGTATCTCACTGATATTCCTGGAAATGCTTTGGTGGGT
CTGGATAGCCTTGAGAGCCTGTCTTTTTATGATAACAAACTGGTTAAAGTCCCTCAACTTGCCCTGCAAAAAGTT
CCAAATTTGAAATTCTTAGACCTCAACAAAAACCCCATTCACAAAATCCAAGAAGGGGACTTCAAAAATATGCTT
CGGTTAAAAGAACTGGGAATCAACAATATGGGCGAGCTCGTTTCTGTCGACCGCTATGCCCTGGATAACTTGCCT
GAACTCACAAAGCTGGAAGCCACCAATAACCCTAAACTCTCTTACATCCACCGCTTGGCTTTCCGAAGTGTCCCT
GCTCTGGAAAGCTTGATGCTGAACAACAATGCCTTGAATGCCATTTACCAAAAGACAGTCGAATCCCTCCCCAAT
CTGCGTGAGATCAGTATCCATAGCAATCCCCTCAGGTGTGACTGTGTGATCCACTGGATTAACTCCAACAAAACC
AACATCCGCTTCATGGAGCCCCTGTCCATGTTCTGTGCCATGCCGCCCGAATATAAAGGGCACCAGGTGAAGGAA
GTTTTAATCCAGGATTCGAGTGAACAGTGCCTCCCAATGATATCTCACGACAGCTTCCCAAATCGTTTAAACGTG
GATATCGGCACGACGGTTTTCCTAGACTGTCGAGCCATGGCTGAGCCAGAACCTGAAATTTACTGGGTCACTCCC
ATTGGAAATAAGATAACTGTGGAAACCCTTTCAGATAAATACAAGCTAAGTAGCGAAGGTACCTTGGAAATATCT
AACATACAAATTGAAGACTCAGGAAGATACACATGTGTTGCCCAGAATGTCCAAGGGGCAGACACTCGGGTGGCA
ACAATTAAGGTTAACGGGACCCTTCTGGATGGTACCCAGGTGCTAAAAATATACGTCAAGCAGACAGAATCCCAT
TCCATCTTAGTGTCCTGGAAAGTTAATTCCAATGTCATGACGTCAAACTTAAAATGGTCGTCTGCCACCATGAAG
ATTGATAACCCTCACATAACATATACTGCCAGGGTCCCAGTCGATGTCCATGAATACAACCTAACGCATCTGCAG
CCTTCCACAGATTATGAAGTGTGTCTCACAGTGTCCAATATTCATCAGCAGACTCAAAAGTCATGCGTAAATGTC
ACAACCAAAAATGCCGCCTTCGCAGTGGACATCTCTGATCAAGAAACCAGTACAGCCCTTGCTGCAGTAATGGGG
TCTATGTTTGCCGTCATTAGCCTTGCGTCCATTGCTGTGTACTTTGCCAAAAGATTTAAGAGAAAAAACTACCAC
CACTCATTAAAAAAGTATATGCAAAAAACCTCTTCAATCCCACTAAATGAGCTGTACCCACCACTCATTAACCTC
TGGGAAGGTGACAGCGAGAAAGACAAAGATGGTTCTGCAGACACCAAGCCAACCCAGGTCGACACATCCAGAAGC
TATTACATGTGGTAACTCAGAGGATATTTTGCTTCTGGTAGTAAGGAGCACAAAGACGTTTTTGCTTTATTCTGC
AAAAGTGAACAAGTTGAAGACTTTTGTATTTTTGACTTTGCTAGTTTGTGGCAGAGTGGAGAGGACGGGTGGATA
TTTCAAATTTTTTTAGTATAGCGTATCGCAAGGGTTTGACACGGCTGCCAGCGACTCTAGGCTTCCAGTCTGTGT
TTGGTTTTTATTCTTATCATTATTATGATTGTTATTATATTATTATTTTATTTTAGTTGTTGTGCTAAACTCAAT
AATGCTGTTCTAACTACAGTGCTCAATAAAATGATTAATGACAGGAAAAAAAAAAAAAAAAAAAAAAAAAAAAAA
AAAAAAAAAAAAAAAAAAAAAAAAAAAAAAAAAAAAAAAAAAA
```

FIGURE 512

```
MARMSFVIAACQLVLGLLMTSLTESSIQNSECPQLCVCEIRPWFTPQSTYREATTVDCNDLRL
TRIPSNLSSDTQVLLLQSNNIAKTVDELQQLFNLTELDFSQNNFTNIKEVGLANLTQLTTLHL
EENQITEMTDYCLQDLSNLQELYINHNQISTISAHAFAGLKNLLRLHLNSNKLKVIDSRWFDS
TPNLEILMIGENPVIGILDMNFKPLANLRSLVLAGMYLTDIPGNALVGLDSLESLSFYDNKLV
KVPQLALQKVPNLKFLDLNKNPIHKIQEGDFKNMLRLKELGINNMGELVSVDRYALDNLPELT
KLEATNNPKLSYIHRLAFRSVPALESLMLNNNALNAIYQKTVESLPNLREISIHSNPLRCDCV
IHWINSNKTNIRFMEPLSMFCAMPPEYKGHQVKEVLIQDSSEQCLPMISHDSFPNRLNVDIGT
TVFLDCRAMAEPEPEIYWVTPIGNKITVETLSDKYLSSEGTLEISNIQIEDSGRYTCVAQNV
QGADTRVATIKVNGTLLDGTQVLKIYVKQTESHSILVSWKVNSNVMTSNLKWSSATMKIDNPH
ITYTARVPVDVHEYNLTHLQPSTDYEVCLTVSNIHQQTQKSCVNVTTKNAAFAVDISDQETST
ALAAVMGSMFAVISLASIAVYFAKRFKRKNYHHSLKKYMQKTSSIPLNELYPPLINLWEGDSE
KDKDGSADTKPTQVDTSRSYYMW
```

Important features:

Signal peptide:

Amino acids 1-25

Transmembrane domain:

Amino acids 508-530

N-glycosylation sites:

Amino acids 69-73;96-100;106-110;117-121;385-389;517-521;
582-586;611-615

Tyrosine kinase phosphorylation site:

Amino acids 573-582

N-myristoylation sites:

Amino acids 16-22;224-230;464-470;637-643;698-704

FIGURE 513

GGGAGAGAGGATAAATAGCAGCGTGGCTTCCCTGGCTCCTCTCTGCATCCTTCCCGACCTTCC
CAGCAATATGCATCTTGCACGTCTGGTCGGCTCCTGCTCCCTCCTTCTGCTACTGGGGCCCT
GTCTGGATGGGCGGCCAGCGATGACCCCATTGAGAAGGTCATTGAAGGGATCAACCGAGGGCT
GAGCAATGCAGAGAGAGAGGTGGGCAAGGCCCTGGATGGCATCAACAGTGGAATCACGCATGC
CGGAAGGGAAGTGGAGAAGGTTTTCAACGGACTTAGCAACATGGGGAGCCACACCGGCAAGGA
GTTGGACAAAGGCGTCCAGGGGCTCAACCACGGCATGGACAAGGTTGCCCATGAGATCAACCA
TGGTATTGGACAAGCAGGAAGGAAGCAGAGAAGCTTGGCCATGGGGTCAACAACGCTGCTGG
ACAGGCCGGGAAGGAAGCAGACAAAGCGGTCCAAGGGTTCCACACTGGGGTCCACCAGGCTGG
GAAGGAAGCAGAGAAACTTGGCCAAGGGGTCAACCATGCTGCTGACCAGGCTGGAAAGGAAGT
GGAGAAGCTTGGCCAAGGTGCCCACCATGCTGCTGGCCAGGCCGGGAAGGAGCTGCAGAATGC
TCATAATGGGGTCAACCAAGCCAGCAAGGAGGCCAACCAGCTGCTGAATGGCAACCATCAAAG
CGGATCTTCCAGCCATCAAGGAGGGGCCACAACCACGCCGTTAGCCTCTGGGGCCTCAGTCAA
CACGCCTTTCATCAACCTTCCCGCCCTGTGGAGGAGCGTCGCCAACATCATGCCCTAAACTGG
CATCCGGCCTTGCTGGGAGAATAATGTCGCCGTTGTCACATCAGCTGACATGACCTGGAGGGG
TTGGGGGTGGGGGACAGGTTTCTGAAATCCCTGAAGGGGGTTGTACTGGGATTTGTAATAAA
CTTGATACACCA

FIGURE 514

MHLARLVGSCSLLLLLGALSGWAASDDPIEKVIEGINRGLSNAEREVGKALDGINSGITHAGR
EVEKVFNGLSNMGSHTGKELDKGVQGLNHGMDKVAHEINHGIGQAGKEAEKLGHGVNNAAGQA
GKEADKAVQGFHTGVHQAGKEAEKLGQGVNHAADQAGKEVEKLGQGAHHAAGQAGKELQNAHN
GVNQASKEANQLLNGNHQSGSSSHQGGATTTPLASGASVNTPFINLPALWRSVANIMP

Important features:
Signal peptide:
amino acids 1-25

Homologous region to circumsporozoite (CS) repeats:
amino acids 35-225

FIGURE 515

```
CCCACGCGTCCGCCCACGCGTCCGGGTGCCACTCGCGCGCCGGCCGCGCTCCGGGCTTCTCTT
TTCCCTCCGACGCGCCACGGCTGCCCAGACATTCCGGCTGCCGGGTCTGGAGAGCTCCCCGAA
CCCCTCCGCGGAGAGGAGCGAGGCGGCGCCAGGGTGGCCCCCGGGGCGCGCTTGGTCTCGGAG
AAGCGGGGACGAGGCCGGAGGATGAGCGACTGAGGGCGACGCGGGCACTGACGCGAGTTGGGG
CCGCGACTACCGGCAGCTGACAGCGCGATGAGCGACTCCCCAGAGACGCCCTAGCCCGGTGTG
CGCGCCAGGCGGAGCGCGCAGGTGGGCTGGGCTGTTAGTGGTCCGCCCCACGCGGGTCGCCG
GCCGGCCCAGGATGGGCGCTGGCAACCCGGGCCCGCGCCCGCCGCTGCTACCCCTGCGCCCGC
TGCGAGCCCGGCGTCCGGCCCGCGCCCTGCGCTCATGGACGGCGGCTCCCGGCTGGCGGCGGC
GCGCCCCGGGCTGTGAATGCGACTCGCCCCTCGGCCGCGCTCCCCGCCCGCCCGCCCGCCGG
GACGTGGTAGGGGATGCCCAGCTCCACTGCGATGGCAGTTGGCGCGCTCTCCAGTTCCCTCCT
GGTCACCTGCTGCCTGATGGTGGCTCTGTGCAGTCCGAGCATCCGCTGGAGAAGCTGGCCCA
GGCACCAGAGCAGCCGGGCCAGGAGAAGCGTGAGCACGCCACTCGGGACGGCCCGGGGCGGGT
GAACGAGCTCGGGCGCCCGGCGAGGGACGAGGGCGGCAGCGGCCGGGACTGGAAGAGCAAGAG
CGGCCGTGGGCTCGCCGGCCGTGAGCCGTGGAGCAAGCTGAAGCAGGCCTGGGTCTCCCAGGG
CGGGGGCGCCAAGGCCGGGGATCTGCAGGTCCGGCCCCGCGGGGACACCCCGCAGGCGGAAGC
CCTGGCCGCAGCCGCCCAGGACGCGATTGGCCCGGAACTCGCGCCCACGCCCGAGCCACCCGA
GGAGTACGTGTACCCGGACTACCGTGGCAAGGGCTGCGTGGACGAGAGCGGCTTCGTGTACGC
GATCGGGGAGAAGTTCGCGCCGGGCCCCTCGGCCTGCCCGTGCCTGTGCACCGAGGAGGGGCC
GCTGTGCGCGCAGCCCGAGTGCCCGAGGCTGCACCCGCGCTGCATCCACGTCGACACGAGCCA
GTGCTGCCCGCAGTGCAAGGAGAGGAAGAACTACTGCGAGTTCCGGGGCAAGACCTATCAGAC
TTTGGAGGAGTTCGTGGTGTCTCCATGCGAGAGGTGTCGCTGTGAAGCCAACGGTGAGGTGCT
ATGCACAGTGTCAGCGTGTCCCCAGACGGAGTGTGTGGACCCTGTGTACGAGCCTGATCAGTG
CTGTCCCATCTGCAAAAATGGTCCAAACTGCTTTGCAGAAACCGCGGTGATCCCTGCTGGCAG
AGAAGTGAAGACTGACGAGTGCACCATATGCCACTGTACTTATGAGGAAGGCACATGGAGAAT
CGAGCGGCAGGCCATGTGCACGAGACATGAATGCAGGCAAATGTAGACGCTTCCCAGAACACA
AACTCTGACTTTTTCTAGAACATTTTACTGATGTGAACATTCTAGATGACTCTGGGAACTATC
AGTCAAAGAAGACTTTTGATGAGGAATAATGGAAAATTGTTGGTACTTTTCCTTTTCTTGATA
ACAGTTACTACAACAGAAGGAAATGGATATATTTCAAAACATCAACAAGAACTTTGGGCATAA
AATCCTTCTCTAAATAAATGTGCTATTTTCACAGTAAGTACACAAAAGTACACTATTATATAT
CAAATGTATTTCTATAATCCCTCCATTAGAGAGCTTATATAAGTGTTTTCTATAGATGCAGAT
TAAAAATGCTGTGTTGTCAACCGTCAAAAAAAAAAAAAAAAAAAAAAAAAA
```

FIGURE 516

MPSSTAMAVGALSSSLLVTCCLMVALCSPSIPLEKLAQAPEQPGQEKREHATRDGPGRVNELG
RPARDEGGSGRDWKSKSGRGLAGREPWSKLKQAWVSQGGGAKAGDLQVRPRGDTPQAEALAAA
AQDAIGPELAPTPEPPEEYVYPDYRGKGCVDESGFVYAIGEKFAPGPSACPCLCTEEGPLCAQ
PECPRLHPRCIHVDTSQCCPQCKERKNYCEFRGKTYQTLEEFVVSPCERCRCEANGEVLCTVS
ACPQTECVDPVYEPDQCCPICKNGPNCFAETAVIPAGREVKTDECTICHCTYEEGTWRIERQA
MCTRHECRQM

Important features:

Signal peptide:

amino acids 1-27

Transmembrane domain:

amino acids 11-30

Glycosaminoglycan attachment site.

amino acids 80-83

N-myristoylation sites.

amino acids 10-15, 102-107, 103-108

Cell attachment sequence.

amino acids 114-117

EGF-like domain cysteine pattern signature.

amino acids 176-187

FIGURE 517

GGACAACCGTTGCTGGGTGTCCCAGGGCCTGAGGCAGGACGGTACTCCGCTGACACCTTCCCT
TTCGGCCTTGAGGTTCCCAGCCTGGTGGCCCCAGGACGTTCCGGTCGCATGGCAGAGTGCTAC
GGACGACGCCTATGAAGCCCTTAGTCCTTCTAGTTGCGCTTTTGCTATGGCCTTCGTCTGTGC
CGGCTTATCCGAGCATAACTGTGACACCTGATGAAGAGCAAAACTTGAATCATTATATACAAG
TTTTAGAGAACCTAGTACGAAGTGTTCCCTCTGGGGAGCCAGGTCGTGAGAAAAATCTAACT
CTCCAAAACATGTTTATTCTATAGCATCAAAGGGATCAAAATTTAAGGAGCTAGTTACACATG
GAGACGCTTCAACTGAGAATGATGTTTTAACCAATCCTATCAGTGAAGAAACTACAACTTTCC
CTACAGGAGGCTTCACACCGGAAATAGGAAAGAAAAAACACACGGAAAGTACCCCATTCTGGT
CGATCAAACCAAACAATGTTTCCATTGTTTTGCATGCAGAGGAACCTTATATTGAAAATGAAG
AGCCAGAGCCAGAGCCGGAGCCAGCTGCAAAACAAACTGAGGCACCAAGAATGTTGCCAGTTG
TTACTGAATCATCTACAAGTCCATATGTTACCTCATACAAGTCACCTGTCACCACTTTAGATA
AGAGCACTGGCATTGAGATCTCTACAGAATCAGAAGATGTTCCTCAGCTCTCAGGTGAAACTG
CGATAGAAAAACCCGAAGAGTTTGGAAAGCACCCAGAGAGTTGGAATAATGATGACATTTTGA
AAAAAATTTTAGATATTAATTCACAAGTGCAACAGGCACTTCTTAGTGACACCAGCAACCCAG
CATATAGAGAAGATATTGAAGCCTCTAAAGATCACCTAAAACGAAGCCTTGCTCTAGCAGCAG
CAGCAGAACATAAATTAAAAACAATGTATAAGTCCCAGTTATTGCCAGTAGGACGAACAAGTA
ATAAAATTGATGACATCGAAACTGTTATTAACATGCTGTGTAATTCTAGATCTAAACTCTATG
AATATTTAGATATTAAATGTGTTCCACCAGAGATGAGAGAAAAGCTGCTACAGTATTCAATA
CATTAAAAAATATGTGTAGATCAAGGAGAGTCACAGCCTTATTAAAAGTTTATTTAAACAATAA
TATAAAAATTTTAAACCTACTTGATATTCCATAACAAAGCTGATTTAAGCAAACTGCATTTTT
TCACAGGAGAAATAATCATATTCGTAATTTCAAAAGTTGTATAAAAATATTTTCTATTGTAGT
TCAAATGTGCCAACATCTTTATGTGTCATGTGTTATGAACAATTTTCATATGCACTAAAAACC
TAATTTAAAATAAAATTTTGGTTCAGGAAAAAA

FIGURE 518

MKPLVLLVALLLWPSSVPAYPSITVTPDEEQNLNHYIQVLENLVRSVPSGEPGREKKSNSPKH
VYSIASKGSKFKELVTHGDASTENDVLTNPISEETTTFPTGGFTPEIGKKKHTESTPFWSIKP
NNVSIVLHAEEPYIENEEPEPEPEPAAKQTEAPRMLPVVTESSTSPYVTSYKSPVTTLDKSTG
IEISTESEDVPQLSGETAIEKPEEFGKHPESWNNDDILKKILDINSQVQQALLSDTSNPAYRE
DIEASKDHLKRSLALAAAAEHKLKTMYKSQLLPVGRTSNKIDDIETVINMLCNSRSKLYEYLD
IKCVPPEMREKAATVFNTLKNMCRSRRVTALLKVY

Important features:
Signal peptide:
amino acids 1-19

FIGURE 519

CGGCTCGAGTGCAGCTGTGGGGAGATTTCAGTGCATTGCCTCCCCTGGGTGCTCTTCATCTTG
GATTTGAAAGTTGAGAGCAGCATGTTTTGCCCACTGAAACTCATCCTGCTGCCAGTGTTACTG
GATTATTCCTTGGGCCTGAATGACTTGAATGTTTCCCCGCCTGAGCTAACAGTCCATGTGGGT
GATTCAGCTCTGATGGGATGTGTTTTCCAGAGCACAGAAGACAAATGTATATTCAAGATAGAC
TGGACTCTGTCACCAGGAGAGCACGCCAAGGACGAATATGTGCTATACTATTACTCCAATCTC
AGTGTGCCTATTGGGCGCTTCCAGAACCGCGTACACTTGATGGGGACATCTTATGCAATGAT
GGCTCTCTCCTGCTCCAAGATGTGCAAGAGGCTGACCAGGGAACCTATATCTGTGAAATCCGC
CTCAAAGGGGAGAGCCAGGTGTTCAAGAAGCGGTGGTACTGCATGTGCTTCCAGAGGAGCCC
AAAGAGCTCATGGTCCATGTGGGTGGATTGATTCAGATGGGATGTGTTTTCCAGAGCACAGAA
GTGAAACACGTGACCAAGGTAGAATGGATATTTTCAGGACGGCGCGCAAAGGAGGAGATTGTA
TTTCGTTACTACCACAAACTCAGGATGTCTGTGGAGTACTCCCAGAGCTGGGGCCACTTCCAG
AATCGTGTGAACCTGGTGGGGACATTTTCCGCAATGACGGTTCCATCATGCTTCAAGGAGTG
AGGGAGTCAGATGGAGGAAACTACACCTGCAGTATCCACCTAGGGAACCTGGTGTTCAAGAAA
ACCATTGTGCTGCATGTCAGCCCGGAAGAGCCTCGAACACTGGTGACCCCGGCAGCCCTGAGG
CCTCTGGTCTTGGGTGGTAATCAGTTGGTGATCATTGTGGGAATTGTCTGTGCCACAATCCTG
CTGCTCCCTGTTCTGATATTGATCGTGAAGAAGACCTGTGGAAATAAGAGTTCAGTGAATTCT
ACAGTCTTGGTGAAGAACACGAAGAAGACTAATCCAGAGATAAAAGAAAAACCCTGCCATTTT
GAAAGATGTGAAGGGGAGAAACACATTTACTCCCCAATAATTGTACGGGAGGTGATCGAGGAA
GAAGAACCAAGTGAAAAATCAGAGGCCACCTACATGACCATGCACCCAGTTTGGCCTTCTCTG
AGGTCAGATCGGAACAACTCACTTGAAAAAAGTCAGGTGGGGGAATGCCAAAAACACAGCAA
GCCTTTTGAGAAGAATGGAGAGTCCCTTCATCTCAGCAGCGGTGGAGACTCTCTCCTGTGTGT
GTCCTGGGCCACTCTACCAGTGATTTCAGACTCCCGCTCTCCCAGCTGTCCTCCTGTCTCATT
GTTTGGTCAATACACTGAAGATGGAGAATTTGGAGCCTGGCAGAGAGACTGGACAGCTCTGGA
GGAACAGGCCTGCTGAGGGGAGGGGAGCATGGACTTGGCCTCTGGAGTGGGACACTGGCCCTG
GGAACCAGGCTGAGCTGAGTGGCCTCAAACCCCCGTTGGATCAGACCCTCCTGTGGGCAGGG
TTCTTAGTGGATGAGTTACTGGGAAGAATCAGAGATAAAAACCAACCCAAATCAA

FIGURE 520

MFCPLKLILLPVLLDYSLGLNDLNVSPPELTVHVGDSALMGCVFQSTEDKCIFKIDWTLSPGE
HAKDEYVLYYYSNLSVPIGRFQNRVHLMGDILCNDGSLLLQDVQEADQGTYICEIRLKGESQV
FKKAVVLHVLPEEPKELMVHVGGLIQMGCVFQSTEVKHVTKVEWIFSGRRAKEEIVFRYYHKL
RMSVEYSQSWGHFQNRVNLVGDIFRNDGSIMLQGVRESDGGNYTCSIHLGNLVFKKTIVLHVS
PEEPRTLVTPAALRPLVLGGNQLVIIVGIVCATILLLPVLILIVKKTCGNKSSVNSTVLVKNT
KKTNPEIKEKPCHFERCEGEKHIYSPIIVREVIEEEEPSEKSEATYMTMHPVWPSLRSDRNNS
LEKKSGGGMPKTQQAF

FIGURE 521

CTATGAAGAAGCTTCCTGGAAAACAATAAGCAAAGGAAAACAAATGTGTCCCATCTCACATGG
TTCTACCCTACTAAAGACAGGAAGATCATAAACTGACAGATACTGAAATTGTAAGAGTTGGAA
ACTACATTTTGCAAAGTCATTGAACTCTGAGCTCAGTTGCAGTACTCGGGAAGCCATGCAGGA
TGAAGATGGATACATCACCTTAAATATTAAAACTCGGAAACCAGCTCTCGTCTCCGTTGGCCC
TGCATCCTCCTCCTGGTGGCGTGTGATGGCTTTGATTCTGCTGATCCTGTGCGTGGGGATGGT
TGTCGGGCTGGTGGCTCTGGGGATTTGGTCTGTCATGCAGCGCAATTACCTACAAGATGAGAA
TGAAAATCGCACAGGAACTCTGCAACAATTAGCAAAGCGCTTCTGTCAATATGTGGTAAAACA
ATCAGAACTAAAGGGCACTTTCAAAGGTCATAAATGCAGCCCTGTGACACAAACTGGAGATA
TTATGGAGATAGCTGCTATGGTTCTTCAGGCACAACTTAACATGGGAAGAGAGTAAGCAGTA
CTGCACTGACATGAATGCTACTCTCCTGAAGATTGACAACCGGAACATTGTGGAGTACATCAA
AGCCAGGACTCATTTAATTCGTTGGGTCGGATTATCTCGCCAGAAGTCGAATGAGGTCTGGAA
GTGGGAGGATGGCTCGGTTATCTCAGAAAATATGTTTGAGTTTTTGGAAGATGGAAAAGGAAA
TATGAATTGTGCTTATTTTCATAATGGGAAAATGCACCCTACCTTCTGTGAGAACAAACATTA
TTTAATGTGTGAGAGGAAGGCTGGCATGACCAAGGTGGACCAACTACCTTAATGCAAAGAGGT
GGACAGGATAACACAGATAAGGGCTTTATTGTACAATAAAGATATGTATGAATGCATCAGTA
GCTGAAAAAAAAAAAAAA

FIGURE 522

MQDEDGYITLNIKTRKPALVSVGPASSSWWRVMALILLILCVGMVVGLVALGIWSVMQRNYLQ
DENENRTGTLQQLAKRFCQYVVKQSELKGTFKGHKCSPCDTNWRYYGDSCYGFFRHNLTWEES
KQYCTDMNATLLKIDNRNIVEYIKARTHLIRWVGLSRQKSNEVWKWEDGSVISENMFEFLEDG
KGNMNCAYFHNGKMHPTFCENKHYLMCERKAGMTKVDQLP

FIGURE 523

CAGCAGTGGTCTCTCAGTCCTCTCAAAGCAAGGAAAGAGTACTGTGTGCTGAGAGACC<u>ATG</u>GC
AAAGAATCCTCCAGAGAATTGTGAAGACTGTCACATTCTAAATGCAGAAGCTTTTAAATCCAA
GAAAATATGTAAATCACTTAAGATTTGTGGACTGGTGTTTGGTATCCTGGCCCTAACTCTAAT
TGTCCTGTTTTGGGGGAGCAAGCACTTCTGGCCGGAGGTACCCAAAAAAGCCTATGACATGGA
GCACACTTTCTACAGCAATGGAGAGAAGAAGAAGATTTACATGGAAATTGATCCTGTGACCAG
AACTGAAATATTCAGAAGCGGAAATGGCACTGATGAAACATTGGAAGTGCACGACTTTAAAAA
CGGATACACTGGCATCTACTTCGTGGGTCTTCAAAAATGTTTTATCAAAACTCAGATTAAAGT
GATTCCTGAATTTTCTGAACCAGAAGAGGAAATAGATGAGAATGAAGAAATTACCACAACTTT
CTTTGAACAGTCAGTGATTTGGGTCCCAGCAGAAAAGCCTATTGAAAACCGAGATTTTCTTAA
AAATTCCAAAATTCTGGAGATTTGTGATAACGTGACCATGTATTGGATCAATCCCACTCTAAT
ATCAGTTTCTGAGTTACAAGACTTTGAGGAGGAGGGAGAAGATCTTCACTTTCCTGCCAACGA
AAAAAAAGGGATTGAACAAAATGAACAGTGGGTGGTCCCTCAAGTGAAAGTAGAGAAGACCCG
TCACGCCAGACAAGCAAGTGAGGAAGAACTTCCAATAAATGACTATACTGAAAATGGAATAGA
ATTTGATCCCATGCTGGATGAGAGAGGTTATTGTTGTATTTACTGCCGTCGAGGCAACCGCTA
TTGCCGCCGCGTCTGTGAACCTTTACTAGGCTACTACCCATATCCATACTGCTACCAAGGAGG
ACGAGTCATCTGTCGTGTCATCATGCCTTGTAACTGGTGGGTGGCCCGCATGCTGGGGAGGGT
C<u>TAA</u>TAGGAGGTTTGAGCTCAAATGCTTAAACTGCTGGCAACATATAATAAATGCATGCTATT
CAATGAATTTCTGCCTATGAGGCATCTGGCCCTGGTAGCCAGCTCTCCAGAATTACTTGTAG
GTAATTCCTCTCTTCATGTTCTAATAAACTTCTACATTATCACCAAAAAAAAAAAAAAAAAA

FIGURE 524

MAKNPPENCEDCHILNAEAFKSKKICKSLKICGLVFGILALTLIVLFWGSKHFWPEVPKKAYD
MEHTFYSNGEKKKIYMEIDPVTRTEIFRSGNGTDETLEVHDFKNGYTGIYFVGLQKCFIKTQI
KVIPEFSEPEEEIDENEEITTTFFEQSVIWVPAEKPIENRDFLKNSKILEICDNVTMYWINPT
LISVSELQDFEEEGEDLHFPANEKKGIEQNEQWVVPQVKVEKTRHARQASEEELPINDYTENG
IEFDPMLDERGYCCIYCRRGNRYCRRVCEPLLGYYPYPYCYQGGRVICRVIMPCNWWVARMLGRV

Important features:
Signal peptide:
amino acids 1-40

Transmembrane domain:
amino acids 25-47 (type II)

N-glycosylation sites.
amino acids 94-97, 180-183

Glycosaminoglycan attachment sites.
amino acids 92-95, 70-73, 85-88, 133-136, 148-151, 192-195, 239-242

N-myristoylation sites.
amino acids 33-38, 95-100, 116-121, 215-220, 272-277

Microbodies C-terminal targeting signal.
amino acids 315-317

Cytochrome c family heme-binding site signature.
amino acids 9-14

FIGURE 525

AGTGACAATCTCAGAGCAGCTTCTACACCACAGCCATTTCCAGCATGAAGATCACTGGGGGTC
TCCTTCTGCTCTGTACAGTGGTCTATTTCTGTAGCAGCTCAGAAGCTGCTAGTCTGTCTCCAA
AAAAAGTGGACTGCAGCATTTACAAGAAGTATCCAGTGGTGGCCATCCCCTGCCCCATCACAT
ACCTACCAGTTTGTGGTTCTGACTACATCACCTATGGGAATGAATGTCACTTGTGTACCGAGA
GCTTGAAAAGTAATGGAAGAGTTCAGTTTCTTCACGATGGAAGTTGCTAAATTCTCCATGGAC
ATAGAGAGAAAGGAATGATATTCTCATCATCATCTTCATCATCCCAGGCTCTGACTGAGTTTC
TTTCAGTTTTACTGATGTTCTGGGTGGGGACAGAGCCAGATTCAGAGTAATCTTGACTGAAT
GGAGAAAGTTTCTGTGCTACCCCTACAAACCCATGCCTCACTGACAGACCAGCATTTTTTTT
TAACACGTCAATAAAAAAATAATCTCCAGA

FIGURE 526

MKITGGLLLLCTVVYFCSSSEAASLSPKKVDCSIYKKYPVVAIPCPITYLPVCGSDYITYGNE
CHLCTESLKSNGRVQFLHDGSC

Important features:

Signal peptide:

amino acids 1-19

FIGURE 527

```
CGACGATGCTACGCGCGCCCGGCTGCCTCCTCCGGACCTCCGTAGCGCCTGCCGCGGCCCTGG
CTGCGGCGCTGCTCTCGTCGCTTGCGCGCTGCTCTCTTCTAGAGCCGAGGGACCCGGTGGCCT
CGTCGCTCAGCCCCTATTTCGGCACCAAGACTCGCTACGAGGATGTCAACCCCGTGCTATTGT
CGGGCCCCGAGGCTCCGTGGCGGGACCCTGAGCTGCTGGAGGGGACCTGCACCCCGGTGCAGC
TGGTCGCCCTCATTCGCCACGGCACCCGCTACCCCACGGTCAAACAGATCCGCAAGCTGAGGC
AGCTGCACGGGTTGCTGCAGGCCCGCGGGTCCAGGGATGGCGGGGCTAGTAGTACCGGCAGCC
GCGACCTGGGTGCAGCGCTGGCCGACTGGCCTTTGTGGTACGCGGACTGGATGGACGGGCAGC
TAGTAGAGAAGGGACGGCAGGATATGCGACAGCTGGCGCTGCGTCTGGCCTCGCTCTTCCCGG
CCCTTTTCAGCCGTGAGAACTACGGCCGCCTGCGGCTCATCACCAGTTCCAAGCACCGCTGCA
TGGATAGCAGCGCCGCCTTCCTGCAGGGGCTGTGGCAGCACTACCACCCTGGCTTGCCGCCGC
CGGACGTCGCAGATATGGAGTTTGGACCTCCAACAGTTAATGATAAACTAATGAGATTTTTTG
ATCACTGTGAGAAGTTTTTAACTGAAGTAGAAAAAAATGCTACAGCTCTTTATCACGTGGAAG
CCTTCAAAACTGGACCAGAAATGCAGAACATTTTAAAAAAAGTTGCAGCTACTTTGCAAGTGC
CAGTAAATGATTTAAATGCAGATTTAATTCAAGTAGCCTTTTTCACCTGTTCATTTGACCTGG
CAATTAAAGGTGTTAAATCTCCTTGGTGTGATGTTTTTGACATAGATGATGCAAAGGTATTAG
AATATTTAAATGATCTGAAACAATATTGGAAAAGAGGATATGGGTATACTATTAACAGTCGAT
CCAGCTGCACCTTGTTTCAGGATATCTTTCAGCACTTGGACAAAGCAGTTGAACAGAAACAAA
GGTCTCAGCCAATTTCTTCTCCAGTCATCCTCCAGTTTGGTCATGCAGAGACTCTTCTTCCAC
TGCTTTCTCTCATGGGCTACTTCAAAGACAAGGAACCCCTAACAGCGTACAATTACAAAAAAC
AAATGCATCGGAAGTTCCGAAGTGGTCTCATTGTACCTTATGCCTCGAACCTGATATTTGTGC
TTTACCACTGTGAAAATGCTAAGACTCCTAAAGAACAATTCCGAGTGCAGATGTTATTAAATG
AAAAGGTGTTACCTTTGGCTTACTCACAAGAAACTGTTTCATTTTATGAAGATCTGAAGAACC
ACTACAAGGACATCCTTCAGAGTTGTCAAACCAGTGAAGAATGTGAATTAGCAAGGGCTAACA
GTACATCTGATGAACTATGAGTAACTGAAGAACATTTTAATTCTTTAGGAATCTGCAATGAG
TGATTACATGCTTGTAATAGGTAGGCAATTCCTTGATTACAGGAAGCTTTTATATTACTTGAG
TATTTCTGTCTTTTCACAGAAAAACATTGGGTTTCTCTCTGGGTTTGGACATGAAATGTAAGA
AAAGATTTTTCACTGGAGCAGCTCTCTTAAGGAGAAACAAATCTATTTAGAGAAACAGCTGGC
CCTGCAAATGTTTACAGAAATGAAATTCTTCCTACTTATATAAGAAATCTCACACTGAGATAG
AATTGTGATTTCATAATAACACTTGAAAAGTGCTGGAGTAACAAAATATCTCAGTTGGACCAT
CCTTAACTTGATTGAACTGTCTAGGAACTTTACAGATTGTTCTGCAGTTCTCTCTTCTTTTCC
TCAGGTAGGACAGCTCTAGCATTTTCTTAATCAGGAATATTGTGGTAAGCTGGGAGTATCACT
CTGGAAGAAAGTAACATCTCCAGATGAGAATTTGAAACAAGAAACAGAGTGTTGTAAAAGGAC
ACCTTCACTGAAGCAAGTCGGAAAGTACAATGAAATAAATATTTTGGTATTTATTTATGAA
ATATTTGAACATTTTTCAATAATTCCTTTTACTTCTAGGAAGTCTCAAAAGACCATCTTAA
ATTATTATATGTTTGGACAATTAGCAACAAGTCAGATAGTTAGAATCGAAGTTTTTCAAATCC
ATTGCTTAGCTAACTTTTTCATTCTGTCACTTGGCTTCGATTTTTATATTTTCCTATTATATG
AAATGTATCTTTTGGTTGTTTGATTTTTCTTTCTTTCTTTGTAAATAGTTCTGAGTTCTGTCA
AATGCCGTGAAAGTATTTGCTATAATAAAGAAAATTCTTGTGACTTTAAAAAAAAAA
```

FIGURE 528

MLRAPGCLLRTSVAPAAALAAALLSSLARCSLLEPRDPVASSLSPYFGTKTRYEDVNPVLLSG
PEAPWRDPELLEGTCTPVQLVALIRHGTRYPTVKQIRKLRQLHGLLQARGSRDGGASSTGSRD
LGAALADWPLWYADWMDGQLVEKGRQDMRQLALRLASLFPALFSRENYGRLRLITSSKHRCMD
SSAAFLQGLWQHYHPGLPPPDVADMEFGPPTVNDKLMRFFDHCEKFLTEVEKNATALYHVEAF
KTGPEMQNILKKVAATLQVPVNDLNADLIQVAFFTCSFDLAIKGVKSPWCDVFDIDDAKVLEY
LNDLKQYWKRGYGYTINSRSSCTLFQDIFQHLDKAVEQKQRSQPISSPVILQFGHAETLLPLL
SLMGYFKDKEPLTAYNYKKQMHRKFRSGLIVPYASNLIFVLYHCENAKTPKEQFRVQMLLNEK
VLPLAYSQETVSFYEDLKNHYKDILQSCQTSEECELARANSTSDEL

Important features:

Signal sequence
amino acids 1-30

N-glycosylation sites.
amino acids 242-246, 481-485

N-myristoylation sites.
amino acids 107-113, 113-119, 117-123, 118-124, 128-134

Endoplasmic reticulum targeting sequence.
amino acids 484-489

FIGURE 529

```
GGAGAGCCGCGGCTGGGACCGGAGTGGGGAGCGCGGCGTGGAGGTGCCACCCGGCGCGGGTGG
CGGAGAGATCAGAAGCCTCTTCCCCAAGCCGAGCCAACCTCAGCGGGGACCCGGGCTCAGGGA
CGCGGCGGCGGCGGCGACTGCAGTGGCTGGACATGGCAGCGTCCGCCGGAGCCGGGGCG
GTGATTGCAGCCCCAGACAGCCGGCGCTGGCTGTGGTCGGTGCTGGCGGCGGCGCTTGGGCTC
TTGACAGCTGGAGTATCAGCCTTGGAAGTATATACGCCAAAAGAAATCTTCGTGGCAAATGGT
ACACAAGGGAAGCTGACCTGCAAGTTCAAGTCTACTAGTACGACTGGCGGGTTGACCTCAGTC
TCCTGGAGCTTCCAGCCAGAGGGGGCCGACACTACTGTGTCGTTTTTCCACTACTCCCAAGGG
CAAGTGTACCTTGGGAATTATCCACCATTTAAAGACAGAATCAGCTGGGCTGGAGACCTTGAC
AAGAAAGATGCATCAATCAACATAGAAAATATGCAGTTTATACACAATGGCACCTATATCTGT
GATGTCAAAAACCCTCCTGACATCGTTGTCCAGCCTGGACACATTAGGCTCTATGTCGTAGAA
AAAGAGAATTTGCCTGTGTTTCCAGTTTGGGTAGTGGTGGGCATAGTTACTGCTGTGGTCCTA
GGTCTCACTCTGCTCATCAGCATGATTCTGGCTGTCCTCTATAGAAGGAAAAACTCTAAACGG
GATTACACTGGCTGCAGTACATCAGAGAGTTTGTCACCAGTTAAGCAGGCTCCTCGGAAGTCC
CCCTCCGACACTGAGGGTCTTGTAAAGAGTCTGCCTTCTGGATCTCACCAGGGCCCAGTCATA
TATGCACAGTTAGACCACTCCGGCGGACATCACAGTGACAAGATTAACAAGTCAGAGTCTGTG
GTGTATGCGGATATCCGAAAGAATTAAGAGAATACCTAGAACATATCCTCAGCAAGAAACAAA
ACCAAACTGGACTCTCGTGCAGAAAATGTAGCCCATTACCACATGTAGCCTTGGAGACCCAGG
CAAGGACAAGTACACGTGTACTCACAGAGGGAGAGAAAGATGTGTACAAAGGATATGTATAAA
TATTCTATTTAGTCATCCTGATATGAGGAGCCAGTGTTGCATGATGAAAAGATGGTATGATTC
TACATATGTACCCATTGTCTTGCTGTTTTTGTACTTTCTTTTCAGGTCATTTACAATTGGGAG
ATTTCAGAAACATTCCTTTCACCATCATTTAGAAATGGTTTGCCTTAATGGAGACAATAGCAG
ATCCTGTAGTATTTCCAGTAGACATGGCCTTTTAATCTAAGGGCTTAAGACTGATTAGTCTTA
GCATTTACTGTAGTTGGAGGATGGAGATGCTATGATGGAAGCATACCCAGGGTGGCCTTTAGC
ACAGTATCAGTACCATTTATTTGTCTGCCGCTTTTAAAAAATACCCATTGGCTATGCCACTTG
AAAACAATTTGAGAAGTTTTTTTGAAGTTTTTCTCACTAAAATATGGGGCAATTGTTAGCCTT
ACATGTTGTGTAGACTTACTTTAAGTTTGCACCCTTGAAATGTGTCATATCAATTTCTGGATT
CATAATAGCAAGATTAGCAAAGGATAAATGCCGAAGGTCACTTCATTCTGGACACAGTTGGAT
CAATACTGATTAAGTAGAAAATCCAAGCTTTGCTTGAGAACTTTTGTAACGTGGAGAGTAAAA
AGTATCGGTTTTA
```

FIGURE 530

MAASAGAGAVIAAPDSRRWLWSVLAAALGLLTAGVSALEVYTPKEIFVANGTQGKLTCKFKST
STTGGLTSVSWSFQPEGADTTVSFFHYSQGQVYLGNYPPFKDRISWAGDLDKKDASINIENMQ
FIHNGTYICDVKNPPDIVVQPGHIRLYVVEKENLPVFPVWVVVGIVTAVVLGLTLLISMILAV
LYRRKNSKRDYTGCSTSESLSPVKQAPRKSPSDTEGLVKSLPSGSHQGPVIYAQLDHSGGHHS
DKINKSESVVYADIRKN

Important features:
Signal peptide:
amino acids 1-37

Transmembrane domain:
amino acids 161-183

FIGURE 531

```
GTGACACTATAGAAGAGCTATGACGTCGCATGCACGCGTACGTAAGCTCGGAATTCGGCTCGA
GGCTGGTGGGAAGAAGCCGAGATGGCGGCAGCCAGCGCTGGGGCAACCCGGCTGCTCCTGCTC
TTGCTGATGGCGGTAGCAGCGCCCAGTCGAGCCCGGGGCAGCGGCTGCCGGGCCGGGACTGGT
GCGCGAGGGGCTGGGGCGGAAGGTCGAGAGGGCGAGGCCTGTGGCACGGTGGGGCTGCTGCTG
GAGCACTCATTTGAGATCGATGACAGTGCCAACTTCCGGAAGCGGGGCTCACTGCTCTGGAAC
CAGCAGGATGGTACCTTGTCCCTGTCACAGCGGCAGCTCAGCGAGGAGGAGCGGGGCCGACTC
CGGGATGTGGCAGCCCTGAATGGCCTGTACCGGGTCCGGATCCCAAGGCGACCCGGGGCCCTG
GATGGCCTGGAAGCTGGTGGCTATGTCTCCTCCTTTGTCCCTGCGTGCTCCCTGGTGGAGTCG
CACCTGTCGGACCAGCTGACCCTGCACGTGGATGTGGCCGGCAACGTGGTGGGCGTGTCGGTG
GTGACGCACCCCGGGGGCTGCCGGGGCCATGAGGTGGAGGACGTGGACCTGGAGCTGTTCAAC
ACCTCGGTGCAGCTGCAGCCGCCCACCACAGCCCCAGGCCCTGAGACGGCGGCCTTCATTGAG
CGCCTGGAGATGGAACAGGCCCAGAAGGCCAAGAACCCCCAGGAGCAGAAGTCCTTCTTCGCC
AAATACTGGATGTACATCATTCCCGTCGTCCTGTTCCTCATGATGTCAGGAGCGCCAGACACC
GGGGGCCAGGGTGGGGGTGGGGGTGGGGGTGGTGGTGGGGGTAGTGGCCTTTGCTGTGTGCCA
CCCTCCCTGTAAGTCTATTTAAAAACATCGACGATACATTGAAATGTGTGAACGTTTTGAAAA
GCTACAGCTTCCAGCAGCCAAAAGCAACTGTTGTTTTGGCAAGACGGTCCTGATGTACAAGCT
TGATTGAAATTCACTGCTCACTTGATACGTTATTCAGAAACCCAAGGAATGGCTGTCCCCATC
CTCATGTGGCTGTGTGGAGCTCAGCTGTGTTGTGTGGCAGTTTATTAAACTGTCCCCCAGATC
GACACGCAAAAAAAAA
```

FIGURE 532

MAAASAGATRLLLLLLMAVAAPSRARGSGCRAGTGARGAGAEGREGEACGTVGLLLEHSFEID
DSANFRKRGSLLWNQQDGTLSLSQRQLSEEERGRLRDVAALNGLYRVRIPRRPGALDGLEAGG
YVSSFVPACSLVESHLSDQLTLHVDVAGNVVGVSVVTHPGGCRGHEVEDVDLELFNTSVQLQP
PTTAPGPETAAFIERLEMEQAQKAKNPQEQKSFFAKYWMYIIPVVLFLMMSGAPDTGGQGGGG
GGGGGGGSGLCCVPPSL

Important features:
Signal peptide:
amino acids 1-24

Transmembrane domain:
amino acids 226-243

FIGURE 533

TCTGCCTCCACTGCTCTGTGCTGGGATCATGGAACTTGCACTGCTGTGTGGGCTGGTGGTGAT

GGCTGGTGTGATTCCAATCCAGGGCGGGATCCTGAACCTGAACAAGATGGTCAAGCAAGTGAC

TGGGAAAATGCCCATCCTCTCCTACTGGCCCTACGGCTGTCACTGCGGACTAGGTGGCAGAGG

CCAACCCAAAGATGCCACGGACTGGTGCTGCCAGACCCATGACTGCTGCTATGACCACCTGAA

GACCCAGGGGTGCGGCATCTACAAGGACAACAACAAAAGCAGCATACATTGTATGGATTTATC

TCAACGCTATTGTTTAATGGCTGTGTTTAATGTGATCTATCTGGAAAATGAGGACTCCGAATA

AAAAGCTATTACTAWTTNAAAAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAA

FIGURE 534

MELALLCGLVVMAGVIPIQGGILNLNKMVKQVTGKMPILSYWPYGCHCGLGGRGQPKDATDWC
CQTHDCCYDHLKTQGCGIYKDNNKSSIHCMDLSQRYCLMAVFNVIYLENEDSE

Important features:

Signal peptide:

amino acids 1-17

Transmembrane domain:

amino acids 1-24

N-glycosylation site.

amino acids 86-89

N-myristoylation sites.

amino acids 20-25, 45-50

Phospholipase A2 histidine active site.

amino acids 63-70

FIGURE 535

```
GCTGAGCGTGTGCGCGGTACGGGGCTCTCCTGCCTTCTGGGCTCCAACGCAGCTCTGTGGCTG
AACTGGGTGCTCATCACGGGAACTGCTGGGCTATGGAATACAGATGTGGCAGCTCAGGTAGCC
CCAAATTGCCTGGAAGAATACATCATGTTTTCGATAAGAAGAAATTGTAGGATCCAGTTTTT
TTTTTAACCGCCCCCTCCCCACCCCCAAAAAAACTGTAAAGATGCAAAAACGTAATATCCAT
GAAGATCCTATTACCTAGGAAGATTTTGATGTTTGCTGCGAATGCGGTGTTGGGATTTATTT
GTTCTTGGAGTGTTCTGCGTGGCTGGCAAAGAATAATGTTCCAAAATCGGTCCATCTCCCAAG
GGGTCCAATTTTTCTTCCTGGGTGTCAGCGAGCCCTGACTCACTACAGTGCAGCTGACAGGGG
CTGTCATGCAACTGGCCCCTAAGCCAAAGCAAAAGACCTAAGGACGACCTTTGAACAATACAA
AGGATGGGTTTCAATGTAATTAGGCTACTGAGCGGATCAGCTGTAGCACTGGTTATAGCCCCC
ACTGTCTTACTGACAATGCTTTCTTCTGCCGAACGAGGATGCCCTAAGGGCTGTAGGTGTGAA
GGCAAAATGGTATATTGTAATCTCAGAAATTACAGGAGATACCCTCAAGTATATCTGCTGGT
TGCTTAGGTTTGTCCCTTCGCTATAACAGCCTTCAAAAACTTAAGTATAATCAATTTAAAGGG
CTCAACCAGCTCACCTGGCTATACCTTGACCATAACCATATCAGCAATATTGACGAAAATGCT
TTTAATGGAATACGCAGACTCAAAGAGCTGATTCTTAGTTCCAATAGAATCTCCTATTTTCTT
AACAATACCTTCAGACCTGTGACAAATTTACGGAACTTGGATCTGTCCTATAATCAGCTGCAT
TCTCTGGGATCTGAACAGTTTCGGGGCTTGCGGAAGCTGCTGAGTTTACATTTACGGTCTAAC
TCCCTGAGAACCATCCCTGTGCGAATATTCCAAGACTGCCGCAACCTGGAACTTTTGGACCTG
GGATATAACCGGATCCGAAGTTTAGCCAGGAATGTCTTTGCTGGCATGATCAGACTCAAAGAA
CTTCACCTGGAGCACAATCAATTTTCCAAGCTCAACCTGGCCCTTTTTCCAAGGTTGGTCAGC
CTTCAGAACCTTTACTTGCAGTGGAATAAAATCAGTGTCATAGGACAGACCATGTCCTGGACC
TGGAGCTCCTTACAAAGGCTTGATTTATCAGGCAATGAGATCGAAGCTTTCAGTGGACCCAGT
GTTTTCCAGTGTGTCCCGAATCTGCAGCGCCTCAACCTGGATTCCAACAAGCTCACATTTATT
GGTCAAGAGATTTTGGATTCTTGGATATCCCTCAATGACATCAGTCTTGCTGGGAATATATGG
GAATGCAGCAGAAATATTTGCTCCCTTGTAAACTGGCTGAAAAGTTTTAAAGGTCTAAGGGAG
AATACAATTATCTGTGCCAGTCCCAAAGAGCTGCAAGGAGTAAATGTGATCGATGCAGTGAAG
AACTACAGCATCTGTGGCAAAAGTACTACAGAGAGGTTTGATCTGGCCAGGGCTCTCCCAAAG
CCGACGTTTAAGCCCAAGCTCCCCAGGCCGAAGCATGAGAGCAAACCCCCTTTGCCCCCGACG
GTGGGAGCCACAGAGCCCGGCCCAGAGACCGATGCTGACGCCAGCACATCTCTTTCCATAAA
ATCATCGCGGGCAGCGTGGCGCTTTTCCTGTCCGTGCTCGTCATCCTGCTGGTTATCTACGTG
TCATGGAAGCGGTACCCTGCGAGCATGAAGCAGCTGCAGCAGCGCTCCCTCATGCGAAGGCAC
AGGAAAAAGAAAAGACAGTCCCTAAAGCAAATGACTCCCAGCACCCAGGAATTTTATGTAGAT
TATAAACCCACCAACACGGAGACCAGCGAGATGCTGCTGAATGGGACGGGACCCTGCACCTAT
AACAAATCGGGCTCCAGGGAGTGTGAGGTATGAACCATTGTGATAAAAGAGCTCTTAAAAGC
TGGGAAATAAGTGGTGCTTTATTGAACTCTGGTGACTATCAAGGGAACGCGATGCCCCCCCTC
CCCTTCCCTCTCCCTCTCACTTTGGTGGCAAGATCCTTCCTTGTCCGTTTTAGTGCATTCATA
ATACTGGTCATTTTCCTCTCATACATAATCAACCCATTGAAATTTAAATACCACAATCAATGT
GAAGCTTGAACTCCGGTTTAATATAATACCTATTGTATAAGACCCTTTACTGATTCCATTAAT
GTCGCATTTGTTTTAAGATAAAACTTCTTTCATAGGTAAAAAAAAAAA
```

FIGURE 536

MGFNVIRLLSGSAVALVIAPTVLLTMLSSAERGCPKGCRCEGKMVYCESQKLQEIPSSISAGC
LGLSLRYNSLQKLKYNQFKGLNQLTWLYLDHNHISNIDENAFNGIRRLKELILSSNRISYFLN
NTFRPVTNLRNLDLSYNQLHSLGSEQFRGLRKLLSLHLRSNSLRTIPVRIFQDCRNLELLDLG
YNRIRSLARNVFAGMIRLKELHLEHNQFSKLNLALFPRLVSLQNLYLQWNKISVIGQTMSWTW
SSLQRLDLSGNEIEAFSGPSVFQCVPNLQRLNLDSNKLTFIGQEILDSWISLNDISLAGNIWE
CSRNICSLVNWLKSFKGLRENTIICASPKELQGVNVIDAVKNYSICGKSTTERFDLARALPKP
TFKPKLPRPKHESKPPLPPTVGATEPGPETDADAEHISFHKIIAGSVALFLSVLVILLVIYVS
WKRYPASMKQLQQRSLMRRHRKKKRQSLKQMTPSTQEFYVDYKPTNTETSEMLLNGTGPCTYN
KSGSRECEV

Important features:

Signal peptide:

amino acids 1-33

Transmembrane domain:

amino acids 420-442

N-glycosylation sites.

amino acids 126-129, 357-360, 496-499, 504-507 cAMP- and cGMP-dependent protein kinase phosphorylation site.

amino acids 465-468

Tyrosine kinase phosphorylation site.

amino acids 136-142

N-myristoylation sites.

amino acids 11-16, 33-38, 245-250, 332-337, 497-502, 507-512

FIGURE 537

```
GGGACTACAAGCCGCGCCGCGCTGCCGCTGGCCCCTCAGCAACCCTCGACATGGCGCTGAGGCGGCCACCGCGAC
TCCGGCTCTGCGCTCGGCTGCCTGACTTCTTCCTGCTGCTGCTTTTCAGGGGCTGCCTGATAGGGGCTGTAAATC
TCAAATCCAGCAATCGAACCCCAGTGGTACAGGAATTTGAAAGTGTGGAACTGTCTTGCATCATTACGGATTCGC
AGACAAGTGACCCCAGGATCGAGTGGAAGAAAATTCAAGATGAACAAACCACATATGTGTTTTTGACAACAAAA
TTCAGGGAGACTTGGCGGGTCGTGCAGAAATACTGGGGAAGACATCCCTGAAGATCTGGAATGTGACACGGAGAG
ACTCAGCCCTTTATCGCTGTGAGGTCGTTGCTCGAAATGACCGCAAGGAAATTGATGAGATTGTGATCGAGTTAA
CTGTGCAAGTGAAGCCAGTGACCCCTGTCTGTAGAGTGCCGAAGGCTGTACCAGTAGGCAAGATGGCAACACTGC
ACTGCCAGGAGAGTGAGGGCCACCCCCGGCCTCACTACAGCTGGTATCGCAATGATGTACCACTGCCCACGGATT
CCAGAGCCAATCCCAGATTTCGCAATTCTTCTTTCCACTTAAACTCTGAAACAGGCACTTTGGTGTTCACTGCTG
TTCACAAGGACGACTCTGGGCAGTACTACTGCATTGCTTCCAATGACGCAGGCTCAGCCAGGTGTGAGGAGCAGG
AGATGGAAGTCTATGACCTGAACATTGGCGGAATTATTGGGGGGGTTCTGGTTGTCCTTGCTGTACTGGCCCTGA
TCACGTTGGGCATCTGCTGTGCATACAGACGTGGCTACTTCATCAACAATAAACAGGATGGAGAAAGTTACAAGA
ACCCAGGGAAACCAGATGGAGTTAACTACATCCGCACTGACGAGGAGGGCGACTTCAGACACAAGTCATCGTTTG
TGATCTGAGACCCGCGGTGTGGCTGAGAGCGCACAGAGCGCACGTGCACATACCTCTGCTAGAAACTCCTGTCAA
GGCAGCGAGAGCTGATGCACTCGGACAGAGCTAGACACTCATTCAGAAGCTTTTCGTTTTGGCCAAAGTTGACCA
CTACTCTTCTTACTCTAACAAGCCACATGAATAGAAGAATTTTCCTCAAGATGGACCCGGTAAATATAACCACAA
GGAAGCGAAACTGGGTGCGTTCACTGAGTTGGGTTCCTAATCTGTTTCTGGCCTGATTCCCGCATGAGTATTAGG
GTGATCTTAAAGAGTTTGCTCACGTAAACGCCCGTGCTGGGCCCTGTGAAGCCAGCATGTTCACCACTGGTCGTT
CAGCAGCCACGACAGCACCATGTGAGATGGCGAGGTGGCTGGACAGCACCAGCAGCGCATCCCGGCGGGAACCCA
GAAAAGGCTTCTTACACAGCAGCCTTACTTCATCGGCCCACAGACACCACCGCAGTTTCTTCTTAAAGGCTCTGC
TGATCGGTGTTGCAGTGTCCATTGTGGAGAAGCTTTTTGGATCAGCATTTTGTAAAAACAACCAAAATCAGGAAG
GTAAATTGGTTGCTGGAAGAGGGATCTTGCCTGAGGAACCCTGCTTGTCCAACAGGGTGTCAGGATTTAAGGAAA
ACCTTCGTCTTAGGCTAAGTCTGAAATGGTACTGAAATATGCTTTTCTATGGGTCTTGTTTATTTTATAAAATTT
TACATCTAAATTTTTGCTAAGGATGTATTTTGATTATTGAAAAGAAAATTTCTATTTAAACTGTAAATATATTGT
CATACAATGTTAAATAACCTATTTTTTTAAAAAAGTTCAACTTAAGGTAGAAGTTCCAAGCTACTAGTGTTAAAT
TGGAAAATATCAATAATTAAGAGTATTTTACCCAAGGAATCCTCTCATGGAAGTTTACTGTGATGTTCCTTTTCT
CACACAAGTTTTAGCCTTTTTCACAAGGGAACTCATACTGTCTACACATCAGACCATAGTTGCTTAGGAAACCTT
TAAAAATTCCAGTTAAGCAATGTTGAAATCAGTTTGCATCTCTTCAAAAGAAACCTCTCAGGTTAGCTTTGAACT
GCCTCTTCCTGAGATGACTAGGACAGTCTGTACCCAGAGGCCACCCAGAAGCCCTCAGATGTACATACACAGATG
CCAGTCAGCTCCTGGGGTTGCGCCAGGCGCCCCCGCTCTAGCTCACTGTTGCCTCGCTGTCTGCCAGGAGGCCCT
GCCATCCTTGGGCCCTGGCAGTGGCTGTGTCCCAGTGAGCTTTACTCACGTGGCCCTTGCTTCATCCAGCACAGC
TCTCAGGTGGGCACTGCAGGGACACTGGTGTCTTCCATGTAGCGTCCCAGCTTTGGGCTCCTGTAACAGACCTCT
TTTTGGTTATGGATGGCTCACAAAATAGGGCCCCCAATGCTATTTTTTTTTTTAAGTTTGTTTAATTATTTGTT
AAGATTGTCTAAGGCCAAAGGCAATTGCGAAATCAAGTCTGTCAAGTACAATAACATTTTTAAAAGAAAATGGAT
CCCACTGTTCCTCTTTGCCACAGAGAAAGCACCCAGACGCCACAGGCTCTGTCGCATTTCAAAACAAACCATGAT
GGAGTGGCGGCCAGTCCAGCCTTTTAAAGAACGTCAGGTGGAGCAGCCAGGTGAAAGGCCTGGCGGGGAGGAAAG
TGAAACGCCTGAATCAAAAGCAGTTTTCTAATTTTGACTTTAAATTTTTCATCCGCCGGAGACACTGCTCCCATT
TGTCGGGGGACATTAGCAACATCACTCAGAAGCCTGTGTTCTTCAAGAGCAGGTGTTCTCAGCCTCACATGCCCT
GCCGTGCTGGACTCAGGACTGAAGTGCTGTAAAGCAAGGAGCTGCTGAGAAGGAGCACTCCACTGTGTGCCTGGA
GAATGGCTCTCACTACTCACCTTGTCTTTCAGCTTCCAGTGTCTTGGGTTTTTATACTTTGACAGCTTTTTTTT
AATTGCATACATGAGACTGTGTTGACTTTTTTTTAGTTATGTGAAACACTTTGCCGCAGGCCGCCTGGCAGAGGCA
GGAAATGCTCCAGCAGTGGCTCAGTGCTCCCTGGTGTCTGCTGCATGGCATCCTGGATGCTTAGCATGCAAGTTC
CCTCCATCATTGCCACCTTGGTAGAGAGGGATGGCTCCCCACCCTCAGCGTTGGGGATTCACGCTCCAGCCTCCT
TCTTGGTTGTCATAGTGATAGGGTAGCCTTATTGCCCCCTCTTCTTATACCCTAAAACCTTCTACACTAGTGCCA
TGGGAACCAGGTCTGAAAAAGTAGAGAGAAGTGAAAGTAGAGTCTGGGAAGTAGCTGCCTATAACTGAGACTAGA
CGGAAAAGGAATACTCGTGTATTTTAAGATATGAATGTGACTCAAGACTCGAGGCCGATACGAGGCTGTGATTCT
GCCTTTGGATGGATGTTGCTGTACACAGATGCTACAGACTTGTACTAACACACCGTAATTTGGCATTTGTTTAAC
CTCATTTATAAAAGCTTCAAAAAAACCCA
```

FIGURE 538

MALRRPPRLRLCARLPDFFLLLLFRGCLIGAVNLKSSNRTPVVQEFESVELSCIITDSQTSDP
RIEWKKIQDEQTTYVFFDNKIQGDLAGRAEILGKTSLKIWNVTRRDSALYRCEVVARNDRKEI
DEIVIELTVQVKPVTPVCRVPKAVPVGKMATLHCQESEGHPRPHYSWYRNDVPLPTDSRANPR
FRNSSFHLNSETGTLVFTAVHKDDSGQYYCIASNDAGSARCEEQEMEVYDLNIGGIIGGVLVV
LAVLALITLGICCAYRRGYFINNKQDGESYKNPGKPDGVNYIRTDEEGDFRHKSSFVI

Important features:

Signal peptide:
amino acids 1-30

Transmembrane domain:
amino acids 243-263

N-glycosylation sites.
amino acids 104-107, 192-195 cAMP- and cGMP-dependent protein kinase phosphorylation site.
amino acids 107-110

Casein kinase II phosphorylation site.
amino acids 106-109, 296-299

Tyrosine kinase phosphorylation site.
amino acids 69-77

N-myristoylation sites.
amino acids 26-31, 215-220, 226-231, 243-248, 244-249, 262-267

FIGURE 539

```
CCAGGACCAGGGCGCACCGGCTCAGCCTCTCACTTGTCAGAGGCCGGGGAAGAGAAGCAAAGC
GCAACGGTGTGGTCCAAGCCGGGGCTTCTGCTTCGCCTCTAGGACATACACGGGACCCCCTAA
CTTCAGTCCCCCAAACGCGCACCCTCGAAGTCTTGAACTCCAGCCCCGCACATCCACGCGCGG
CACAGGCGCGGCAGGCGGCAGGTCCCGGCCGAAGGCGATGCGCGCAGGGGGTCGGGCAGCTGG
GCTCGGGCGGCGGGAGTAGGGCCCGGCAGGGAGGCAGGGAGGCTGCATATTCAGAGTCGCGGG
CTGCGCCCTGGGCAGAGGCCGCCCTCGCTCCACGCAACACCTGCTGCTGCCACCGCGCCGCGA
TGAGCCGCGTGGTCTCGCTGCTGCTGGGCGCCGCGCTGCTCTGCGGCCACGGAGCCTTCTGCC
GCCGCGTGGTCAGCGGCCAAAAGGTGTGTTTTGCTGACTTCAAGCATCCCTGCTACAAAATGG
CCTACTTCCATGAACTGTCCAGCCGAGTGAGCTTTCAGGAGGCACGCCTGGCTTGTGAGAGTG
AGGGAGGAGTCCTCCTCAGCCTTGAGAATGAAGCAGAACAGAAGTTAATAGAGAGCATGTTGC
AAAACCTGACAAAACCCGGGACAGGGATTTCTGATGGTGATTTCTGGATAGGGCTTTGGAGGA
ATGGAGATGGGCAAACATCTGGTGCCTGCCCAGATCTCTACCAGTGGTCTGATGGAAGCAATT
CCCAGTACCGAAACTGGTACACAGATGAACCTTCCTGCGGAAGTGAAAAGTGTGTTGTGATGT
ATCACCAACCAACTGCCAATCCTGGCCTTGGGGGTCCCTACCTTTACCAGTGGAATGATGACA
GGTGTAACATGAAGCACAATTATATTTGCAAGTATGAACCAGAGATTAATCCAACAGCCCTG
TAGAAAAGCCTTATCTTACAAATCAACCAGGAGACACCCATCAGAATGTGGTTGTTACTGAAG
CAGGTATAATTCCCAATCTAATTTATGTTGTTATACCAACAATACCCCTGCTCTTACTGATAC
TGGTTGCTTTTGGAACCTGTTGTTTCCAGATGCTGCATAAAAGTAAAGGAAGAACAAAAACTA
GTCCAAACCAGTCTACACTGTGGATTTCAAAGAGTACCAGAAAAGAAAGTGGCATGGAAGTAT
AATAACTCATTGACTTGGTTCCAGAATTTTGTAATTCTGGATCTGTATAAGGAATGGCATCAG
AACAATAGCTTGGAATGGCTTGAAATCACAAAGGATCTGCAAGATGAACTGTAAGCTCCCCCT
TGAGGCAAATATTAAAGTAATTTTTATATGTCTATTATTTCATTTAAAGAATATGCTGTGCTA
ATAATGGAGTGAGACATGCTTATTTGCTAAAGGATGCACCCAAACTTCAAACTTCAAGCAAA
TGAAATGGACAATGCAGATAAAGTTGTTATCAACACGTCGGGAGTATGTGTGTTAGAAGCAAT
TCCTTTTATTTCTTTCACCTTTCATAAGTTGTTATCTAGTCAATGTAATGTATATTGTATTGA
AATTTACAGTGTGCAAAAGTATTTTACCTTTGCATAAGTGTTTGATAAAAATGAACTGTTCTA
ATATTTATTTTTATGGCATCTCATTTTTCAATACATGCTCTTTTGATTAAAGAAACTTATTAC
TGTTGTCAACTGAATTCACACACACACAAATATAGTACCATAGAAAAGTTTGTTTTCTCGAA
ATAATTCATCTTTCAGCTTCTCTGCTTTTGGTCAATGTCTAGGAAATCTCTTCAGAAATAAGA
AGCTATTTCATTAAGTGTGATATAAACCTCCTCAAACATTTTACTTAGAGGCAAGGATTGTCT
AATTTCAATTGTGCAAGACATGTGCCTTATAATTATTTTAGCTTAAAATTAAACAGATTTTG
TAATAATGTAACTTTGTTAATAGGTGCATAAACACTAATGCAGTCAATTTGAACAAAAGAAGT
GACATACACAATATAAATCATATGTCTTCACACGTTGCCTATATAATGAGAAGCAGCTCTCTG
AGGGTTCTGAAATCAATGTGGTCCCTCTCTTGCCCACTAAACAAAGATGGTTGTTCGGGGTTT
GGGATTGACACTGGAGGCAGATAGTTGCAAAGTTAGTCTAAGGTTTCCCTAGCTGTATTTAGC
CTCTGACTATATTAGTATACAAAGAGGTCATGTGGTTGAGACCAGGTGAATAGTCACTATCAG
TGTGGAGACAAGCACAGCACACAGACATTTTAGGAAGGAAAGGAACTACGAAATCGTGTGAAA
ATGGGTTGGAACCCATCAGTGATCGCATATTCATTGATGAGGGTTTGCTTGAGATAGAAAATG
GTGGCTCCTTTCTGTCTTATCTCCTAGTTTCTTCAATGCTTACGCCTTGTTCTTCTCAAGAGA
AAGTTGTAACTCTCTGGTCTTCATATGTCCCTGTGCTCCTTTTAACCAAATAAAGAGTTCTTG
TTTCTGGGGGAAAAAAAAAAAAAAAAAAAAAAAAAAAAAAAAAAAAAAAAA
```

FIGURE 540

MSRVVSLLLGAALLCGHGAFCRRVVSGQKVCFADFKHPCYKMAYFHELSSRVSFQEARLACES
EGGVLLSLENEAEQKLIESMLQNLTKPGTGISDGDFWIGLWRNGDGQTSGACPDLYQWSDGSN
SQYRNWYTDEPSCGSEKCVVMYHQPTANPGLGGPYLYQWNDDRCNMKHNYICKYEPEINPTAP
VEKPYLTNQPGDTHQNVVVTEAGIIPNLIYVVIPTIPLLLLILVAFGTCCFQMLHKSKGRTKT
SPNQSTLWISKSTRKESGMEV

Important features:

Signal peptide:
amino acids 1-21

Transmembrane domain:
amino acids 214-235

N-glycosylation sites.
amino acids 86-89 and 255-258 cAMP- and cGMP-dependent protein kinase phosphorylation site.
amino acids 266-269

N-myristoylation sites.
amino acids 27-32, 66-71, 91-96, 93-98, 102-107, 109-114, 140-145 and 212-217

FIGURE 541

```
GGAGAATGGAGAGAGCAGTGAGAGTGGAGTCCGGGGTCCTGGTCGGGGTGGTCTGTCTGCTCCTGGCATGCCCTG
CCACAGCCACTGGGCCCGAAGTTGCTCAGCCTGAAGTAGACACCACCCTGGGTCGTGTGCGAGGCCGGCAGGTGG
GCGTGAAGGGCACAGACCGCCTTGTGAATGTCTTTCTGGGCATTCCATTTGCCCAGCCGCCACTGGGCCCTGACC
GGTTCTCAGCCCCACACCCAGCACAGCCCTGGGAGGGTGTGCGGGATGCCAGCACTGCGCCCCAATGTGCCTAC
AAGACGTGGAGAGCATGAACAGCAGCAGATTTGTCCTCAACGGAAAACAGCAGATCTTCTCCGTTTCAGAGGACT
GCCTGGTCCTCAACGTCTATAGCCCAGCTGAGGTCCCCGCAGGGTCCGGTAGGCCGGTCATGGTATGGGTCCATG
GAGGCGCTCTGATAACTGGCGCTGCCACCTCCTACGATGGATCAGCTCTGGCTGCCTATGGGGATGTGGTCGTGG
TTACAGTCCAGTACCGCCTTGGGGTCCTTGGCTTCTTCAGCACTGGAGATGAGCATGCACCTGGCAACCAGGGCT
TCCTAGATGTGGTAGCTGCTTTGCGCTGGGTGCAAGAAAACATCGCCCCCTTCGGGGGTGACCTCAACTGTGTCA
CTGTCTTTGGTGGATCTGCCGGTGGGAGCATCATCTCTGGCCTGGTCCTGTCCCCAGTGGCTGCAGGGCTGTTCC
ACAGAGCCATCACACAGAGTGGGGTCATCACCACCCCAGGGATCATCGACTCTCACCCTTGGCCCCTAGCTCAGA
AAATCGCAAACACCTTGGCCTGCAGCTCCAGCTCCCCGGCTGAGATGGTGCAGTGCCTTCAGCAGAAAGAAGGAG
AAGAGCTGGTCCTTAGCAAGAAGCTGAAAAATACTATCTATCCTCTCACCGTTGATGGCACTGTCTTCCCCAAAA
GCCCCAAGGAACTCCTGAAGGAGAAGCCCTTCCACTCTGTGCCCTTCCTCATGGGTGTCAACAACCATGAGTTCA
GCTGGCTCATCCCCAGGGGCTGGGGTCTCCTGGATACAATGGAGCAGATGAGCCGGGAGGACATGCTGGCCATCT
CAACACCCGTCTTGACCAGTCTGGATGTGCCCCCTGAGATGATGCCCACCGTCATAGATGAATACCTAGGAAGCA
ACTCGGACGCACAAGCCAAATGCCAGGCGTTCCAGGAATTCATGGGTGACGTATTCATCAATGTTCCCACCGTCA
GTTTTTCAAGATACCTTCGAGATTCTGGAAGCCCTGTCTTTTTCTATGAGTTCCAGCATCGACCCAGTTCTTTTG
CGAAGATCAAACCTGCCTGGGTGAAGGCTGATCATGGGGCCGAGGGTGCTTTTGTGTTCGGAGGTCCCTTCCTCA
TGGACGAGAGCTCCCGCCTGGCCTTTCCAGAGGCCACAGAGGAGGGAGAAGCAGCTAAGCCTCACCATGATGGCCC
AGTGGACCCACTTTGCCCGGACAGGGGACCCCAATAGCAAGGCTCTGCCTCCTTGGCCCCAATTCAACCAGGCGG
AACAATATCTGGAGATCAACCCAGTGCCACGGGCCGGACAGAAGTTCAGGGAGGCCTGGATGCAGTTCTGGTCAG
AGACGCTCCCCAGCAAGATACAACAGTGGCACCAGAAGCAGAAGAACAGGAAGGCCCAGGAGGACCTCTGAGGCC
AGGCCTGAACCTTCTTGGCTGGGGCAAACCACTCTTCAAGTGGTGGCAGAGTCCCAGCACGGCAGCCCGCCTCTC
CCCCTGCTGAGACTTTAATCTCCACCAGCCCTTAAAGTGTCGGCCGCTCTGTGACTGGAGTTATGCTCTTTTGAA
ATGTCACAAGGCCGCCTCCCACCTCTGGGGCATTGTACAAGTTCTTCCCTCTCCCTGAAGTGCCTTTCCTGCTTT
CTTCGTGGTAGGTTCTAGCACATTCCTCTAGCTTCCTGGAGGACTCACTCCCCAGGAAGCCTTCCCTGCCTTCTC
TGGGCTGTGCGGCCCCGAGTCTGCGTCCATTAGAGCACAGTCCACCCGAGGCTAGCACCGTGTCTGTGTCTGTCT
CCCCCTCAGAGGAGCTCTCTCAAAATGGGGATTAGCCTAACCCCACTCTGTCACCCACACCAGGATCGGGTGGGA
CCTGGAGCTAGGGGGTGTTTGCTGAGTGAGTGAGTGAAACACAGAATATGGGAATGGCAGCTGCTGAACTTGAAC
CCAGAGCCTTCAGGTGCCAAAGCCATACTCAGGCCCCCACCGACATTGTCCACCCTGGCCAGAAGGGTGCATGCC
AATGGCAGAGACCTGGGATGGGAGAAGTCCTGGGGCGCCAGGGGATCCAGCCTAGAGCAGACCTTAGCCCCTGAC
TAAGGCCTCAGACTAGGGCGGGAGGGGTCTCCTCCTCTCTGCTGCCCAGTCCTGGCCCCTGCACAAGACAACAGA
ATCCATCAGGGCCATGAGTGTCACCCAGACCTGACCCTCACCAATTCCAGCCCCTGACCCTCAGGACGCTGGATG
CCAGCTCCCAGCCCCAGTGCCGGGTCCTCCCTCCCTTCCTGGCTTGGGGAGACCAGTTTCTGGGGAGCTTCCAAG
AGCACCCACCAAGACACAGCAGGCAGGCCAGGGGAGGGCATCTGGACCAGGGCATCCGTCGGGCTATTGTCACA
GAGAAAAGAAGAGACCCACCCACTCGGGCTGCAAAAGGTGAAAAGCACCAAGAGGTTTTCAGATGGAAGTGAGAG
GTGACAGTGTGCTGGCAGCCCTCACAGCCCTCGCTTGCTCTCCCTGCCGCCTCTGCCTGGGCTCCCACTTTGGCA
GCACTTGAGGAGCCCTTCAACCCGCCGCTGCACTGTAGGAGCCCCTTTCTGGGCTGGCCAAGGCCGGAGCCAGCT
CCCTCAGCTTGCGGGGAGGTGCGGAGGGAGAGGGCGGGCAGGAACCGGGGCTGCGCGCAGCGCTTGCGGGCCAG
AGTGAGTTCCGGGTGGGCGTGGGCTCGGCGGGGCCCCACTCAGAGCAGCTGGCCGGCCCCAGGCAGTGAGGGCCT
TAGCACCTGGGCCAGCAGCTGCTGTGCTCGATTTCTCGCTGGGCCTTAGCTGCCTCCCCGCGGGCAGGGCTCGG
GACCTGCAGCCCTCCATGCCTGACCCTCCCCCACCCCCGTGGGCTCCTGTGCGGCCGGAGCCTCCCCAAGGAG
CGCCGCCCCTGCTCCACAGCGCCCAGTCCCATCGACCACCCAAGGGCTGAGGAGTGCGGGTGCACAGCGCGGGA
CTGGCAGGCAGCTCCACCTGCTGCCCCAGTGCTGGATCCACTGGGTGAAGCCAGCTGGGCTCCTGAGTCTGGTGG
GGACTTGGAGAACCTTTATGTCTAGCTAAGGGATTGTAAATACACCGATGGGCACTCTGTATCTAGCTCAAGGTT
TGTAAACACACCAATCAGCACCCTGTGTCTAGCTCAGTGTTTGTGAATGCACCAATCCACACTCTGTATCTGGCT
ACTCTGGTGGGGACTTGGAGAACCTTTGTGTCCACACTCTGTATCTAGCTAATCTAGTGGGGATGTGGAGAACCT
TTGTGTCTAGCTCAGGGATCGTAAACGCACCAATCAGCACCCTGTCAAAACAGACCACTTGACTCTCTGTAAAAT
GGACCAATCAGCAGGATGTGGGTGGGCGAGACAAGAGAATAAAAGCAGGCTGCCTGAGCCAGCAGTGACAACCC
CCCTCGGGTCCCCTCCCACGCCGTGGAAGCTTGTTCTTTCGCTCTTTGCAATAAATCTTGCTACTGCCCAAAA
```

FIGURE 542

MERAVRVESGVLVGVVCLLLACPATATGPEVAQPEVDTTLGRVRGRQVGVKGTDRLVNVFLGI
PFAQPPLGPDRFSAPHPAQPWEGVRDASTAPPMCLQDVESMNSSRFVLNGKQQIFSVSEDCLV
LNVYSPAEVPAGSGRPVMVWVHGGALITGAATSYDGSALAAYGDVVVVTVQYRLGVLGFFSTG
DEHAPGNQGFLDVVAALRWVQENIAPFGGDLNCVTVFGGSAGGSIISGLVLSPVAAGLFHRAI
TQSGVITTPGIIDSHPWPLAQKIANTLACSSSSPAEMVQCLQQKEGEELVLSKKLKNTIYPLT
VDGTVFPKSPKELLKEKPFHSVPFLMGVNNHEFSWLIPRGWGLLDTMEQMSREDMLAISTPVL
TSLDVPPEMMPTVIDEYLGSNSDAQAKCQAFQEFMGDVFINVPTVSFSRYLRDSGSPVFFYEF
QHRPSSFAKIKPAWVKADHGAEGAFVFGGPFLMDESSRLAFPEATEEEKQLSLTMMAQWTHFA
RTGDPNSKALPPWPQFNQAEQYLEINPVPRAGQKFREAWMQFWSETLPSKIQQWHQKQKNRKA
QEDL

Important features:
Signal peptide:
amino acids 1-27

Transmembrane domain:
amino acids 226-245

N-glycosylation site.
amino acids 105-109

N-myristoylation sites.
amino acids 10-16, 49-55, 62-68, 86-92, 150-156, 155-161, 162-168, 217-223, 227-233, 228-234, 232-238, 262-268, 357-363, 461-467

Prokaryotic membrane lipoprotein lipid attachment site.
amino acids 12-23

Carboxylesterases type-B serine active site.
amino acids 216-232

FIGURE 543

```
TGTCGCCTGGCCCTCGCCATGCAGACCCGCGAGCGTCCCCTCCCCGCCCGGCCCTCCTGCTTCTGCTGCTA
CTGGGGGGCGCCCACGGCCTCTTTCCTGAGGAGCCGCCGCCGCTTAGCGTGGCCCCCAGGGACTACCTGAACCAC
TATCCCGTGTTTGTGGGCAGCGGGCCCGGACGCCTGACCCCCGCAGAAGGTGCTGACGACCTCAACATCCAGCGA
GTCCTGCGGGTCAACAGGACGCTGTTCATTGGGGACAGGGACAACCTCTACCGCGTAGAGCTGGAGCCCCCCACG
TCCACGGAGCTGCGGTACCAGAGGAAGCTGACCTGGAGATCTAACCCCAGCGACATAAACGTGTGTCGGATGAAG
GGCAAACAGGAGGGCGAGTGTCGAAACTTCGTAAAGGTGCTGCTCCTTCGGGACGAGTCCACGCTCTTTGTGTGC
GGTTCCAACGCCTTCAACCCGGTGTGCGCCAACTACAGCATAGACACCCTGCAGCCCGTCGGAGACAACATCAGC
GGTATGGCCCGCTGCCCGTACGACCCCAAGCACGCCAATGTTGCCCTCTTCTCTGACGGGATGCTCTTCACAGCT
ACTGTTACCGACTTCCTAGCCATTGATGCTGTCATCTACCGCAGCCTCGGGGACAGGCCCACCCTGCGCACCGTG
AAACATGACTCCAAGTGGTTCAAAGAGCCTTACTTTGTCCATGCGGTGGAGTGGGGCAGCCATGTCTACTTCTTC
TTCCGGGAGATTGCGATGGAGTTTAACTACCTGGAGAAGGTGGTGGTGTCCCGCGTGGCCCGAGTGTGCAAGAAC
GACGTGGGAGGCTCCCCCCGCGTGCTGGAGAAGCAGTGGACGTCCTTCCTGAAGGCGCGGCTCAACTGCTCTGTA
CCCGGAGACTCCCATTTCTACTTCAACGTGCTGCAGGCTGTCACGGGCGTGGTCAGCCTCGGGGGCCGGCCCGTG
GTCCTGGCCGTTTTTTCCACGCCCAGCAACAGCATCCCTGGCTCGGCTGTCTGCGCCTTTGACCTGACACAGGTG
GCAGCTGTGTTTGAAGGCCGCTTCCGAGAGCAGAAGTCCCCCGAGTCCATCTGGACGCCGGTGCCGGAGGATCAG
GTGCCTCGACCCCGGCCCGGGTGCTGCGCAGCCCCCGGGATGCAGTACAATGCCTCCAGCGCCTTGCCGGATGAC
ATCCTCAACTTTGTCAAGACCCACCCTCTGATGGACGAGGCGGTGCCCTCGCTGGGCCATGCGCCCTGGATCCTG
CGGACCCTGATGAGGCACCAGCTGACTCGAGTGGCTGTGGACGTGGGAGCCGGCCCCTGGGGCAACCAGACCGTT
GTCTTCCTGGGTTCTGAGGCGGGGACGGTCCTCAAGTTCCTCGTCCGGCCCAATGCCAGCACCTCAGGGACGTCT
GGGCTCAGTGTCTTCCTGGAGGAGTTTGAGACCTACCGGCCGGACAGGTGTGGACGGCCCGGCGGTGGCGAGACA
GGGCAGCGGCTGCTGAGCTTGGAGCTGGACGCAGCTTCGGGGGGCCTGCTGGCTGCCTTCCCCGCTGCGTGGTC
CGAGTGCCTGTGGCTCGCTGCCAGCAGTACTCGGGGTGTATGAAGAACTGTATCGGCAGTCAGGACCCCTACTGC
GGGTGGGCCCCCGACGGCTCCTGCATCTTCCTCAGCCCGGGCACCAGAGCCGCCTTTGAGCAGGACGTGTCCGGG
GCCAGCACCTCAGGCTTAGGGGACTGCACAGGACTCCTGCGGGCCAGCCTCTCCGAGGACCGCGCGGGGCTGGTG
TCGGTGAACCTGCTGGTAACGTCGTCGGTGGCGGCCTTCGTGGTGGGAGCCGTGGTGTCCGGCTTCAGCGTGGGC
TGGTTCGTGGGCCTCCGTGAGCGGCGGGAGCTGGCCCGGCGCAAGGACAAGGAGGCCATCCTGGCGCACGGGGCG
GGCGAGGCGGTGCTGAGCGTCAGCCGCCTGGGCGAGCGCAGGGCGCAGGGTCCCGGGGGCCGGGGCGGAGGCGGT
GGCGGTGGCGCCGGGGTTCCCCCGGAGGCCCTGCTGGCGCCCCTGATGCAGAACGGCTGGGCCAAGGCCACGCTG
CTGCAGGGCGGGCCCCACGACCTGGACTCGGGGCTGCTGCCCACGCCCGAGCAGACGCCGCTGCCGCAGAAGCGC
CTGCCCACTCCGCACCCGCACCCCCACGCCCTGGGCCCCGCGCCTGGGACCACGGCCACCCCCTGCTCCCGGCC
TCCGCTTCATCCTCCCTCCTGCTGCTGGCGCCCGCCCGGGCCCCCGAGCAGCCCCCCGCGCCTGGGGAGCCGACC
CCCGACGGCCGCCTCTATGCTGCCCGGCCCGGCCGCCTCCCACGCGACTTCCCGCTCACCCCCCACGCCAGC
CCGGACCGCCGGCGGGTGGTGTCCGCGCCCACGGGCCCCTTGGACCCAGCCTCAGCCGCCGATGGCCTCCCGCGG
CCCTGGAGCCCGCCCCCGACGGGCAGCCTGAGGAGGCCACTGGGCCCCACGCCCCTCCGGCCGCCACCCTGCGC
CGCACCCACACGTTCAACAGCGGCGAGGCCCGGCCTGGGGACCGCCACCGCGGCTGCCACGCCCGGCCGGGCACA
GACTTGGCCCACCTCCTCCCCTATGGGGGGCGGACAGGACTGCGCCCCCCGTGCCCTAGGCCGGGGGCCCCCCG
ATGCCTTGGCAGTGCCAGCCACGGGAACCAGGAGCGAGAGACGGTGCCAGAACGCCGGGGCCCGGGGCAACTCCG
AGTGGGTGCTCAAGTCCCCCCCGCGACCCACCCGCGGAGTGGGGGGCCCCCTCCGCCACAAGGAAGCACAACCAG
CTCGCCCTCCCCCTACCCGGGGCCGCAGGACGCTGAGACGGTTTGGGGGTGGGTGGGCGGGAGGACTTTGCTATG
GATTTGAGGTTGACCTTATGCGCGTAGGTTTTGGTTTTTTTTGCAGTTTTGGTTTCTTTTGCGGTTTTCTAACC
AATTGCACAACTCCGTTCTCGGGGTGGCGGCAGGCAGGGGAGGCTTGGACGCCGGTGGGGAATGGGGGGCCACAG
CTGCAGACCTAAGCCCTCCCCCACCCCTGGAAAGGTCCCTCCCCAACCCAGGCCCTGGCGTGTGTGGGTGTGCG
TGCGTGTGCGTGCCGTGTTCGTGTGCAAGGGGCCGGGGAGGTGGGCGTGTGTGCGTGCCAGCGAAGGCTGCTG
TGGGCGTGTGTGTCAAGTGGCCACGCGTGCAGGGTGTGTGTCCACGAGCGACGATCGTGGTGGCCCCAGCGGCC
TGGGCGTTGGCTGAGCCGACGCTGGGGCTTCCAGAAGGCCCGGGGTCTCCGAGGTGCCGGTTAGGAGTTTGAAC
CCCCCCCACTCTGCAGAGGGAAGCGGGACAATGCCGGGGTTTCAGGCAGGAGACACGAGGAGGGCCTGCCCGGA
AGTCACATCGGCAGCAGCTGTCTAAAGGGCTTGGGGGCCTGGGGGGCGGCGAAGGTGGGTGGGCCCCTCTGTAA
ATACGGCCCCAGGGTGGTGAGAGAGTCCCATGCCACCCGTCCCCTTGTGACCTCCCCCCTATGACCTCCAGCTGA
CCATGCATGCCACGTGGCTGGCTGGGTCCTCTGCCCTCTTTGGAGTTTGCCTCCCCCAGCCCCCTCCCCATCAAT
AAAACTCTGTTTACAACCAAAAAAAAAAAAAAAAAAAAAAAAAAAAA
```

FIGURE 544

```
MQTPRASPPRPALLLLLLLLGGAHGLFPEEPPPLSVAPRDYLNHYPVFVGSGPGRLTPAEGAD
DLNIQRVLRVNRTLFIGDRDNLYRVELEPPTSTELRYQRKLTWRSNPSDINVCRMKGKQEGEC
RNFVKVLLLRDESTLFVCGSNAFNPVCANYSIDTLQPVGDNISGMARCPYDPKHANVALFSDG
MLFTATVTDFLAIDAVIYRSLGDRPTLRTVKHDSKWFKEPYFVHAVEWGSHVYFFFREIAMEF
NYLEKVVVSRVARVCKNDVGGSPRVLEKQWTSFLKARLNCSVPGDSHFYFNVLQAVTGVVSLG
GRPVVLAVFSTPSNSIPGSAVCAFDLTQVAAVFEGRFREQKSPESIWTPVPEDQVPRPRPGCC
AAPGMQYNASSALPDDILNFVKTHPLMDEAVPSLGHAPWILRTLMRHQLTRVAVDVGAGPWGN
QTVVFLGSEAGTVLKFLVRPNASTSGTSGLSVFLEEFETYRPDRCGRPGGGETGQRLLSLELD
AASGGLLAAFPRCVVRVPVARCQQYSGCMKNCIGSQDPYCGWAPDGSCIFLSPGTRAAFEQDV
SGASTSGLGDCTGLLRASLSEDRAGLVSVNLLVTSSVAAFVVGAVVSGFSVGWFVGLRERREL
ARRKDKEAILAHGAGEAVLSVSRLGERRAQGPGGRGGGGGGAGVPPEALLAPLMQNGWAKAT
LLQGGPHDLDSGLLPTPEQTPLPQKRLPTPHPHPHALGPRAWDHGHPLLPASASSSLLLLAPA
RAPEQPPAPGEPTPDGRLYAARPGRASHGDFPLTPHASPDRRRVVSAPTGPLDPASAADGLPR
PWSPPPTGSLRRPLGPHAPPAATLRRTHTFNSGEARPGDRHRGCHARPGTDLAHLLPYGGADR
TAPPVP
```

Important features:

Signal peptide:

amino acids 1-25

Transmembrane domains:

amino acids 318-339, 598-617

N-glycosylation sites.

amino acids 74-78, 155-159, 167-171, 291-295, 386-390, 441-445, 462-466

Glycosaminoglycan attachment sites.

amino acids 51-55, 573-577 cAMP- and cGMP-dependent protein kinase phosphorylation site.

amino acids 102-106

N-myristoylation sites.

amino acids 21-27, 50-56, 189-195, 333-339, 382-388, 448-454, 490-496, 491-497, 508-514, 509-515, 531-537, 558-564, 569-575, 574-580, 580-586, 610-616, 643-649, 663-669, 666-672, 667-673, 668-674, 669-675, 670-676, 868-874, 879-885

FIGURE 545

```
GATGGCGCAGCCACAGCTTCTGTGAGATTCGATTTCTCCCCAGTTCCCCTGTGGGTCTGAGGG
GACCAGAAGGGTGAGCTACGTTGGCTTTCTGGAAGGGGAGGCTATATGCGTCAATTCCCCAAA
ACAAGTTTTGACATTTCCCCTGAAATGTCATTCTCTATCTATTCACTGCAAGTGCCTGCTGTT
CCAGGCCTTACCTGCTGGGCACTAACGGCGGAGCCAGGATGGGGACAGAATAAAGGAGCCACG
ACCTGTGCCACCAACTCGCACTCAGACTCTGAACTCAGACCTGAAATCTTCTCTTCACGGGAG
GCTTGGCAGTTTTTCTTACTCCTGTGGTCTCCAGATTTCAGGCCTAAGATGAAAGCCTCTAGT
CTTGCCTTCAGCCTTCTCTCTGCTGCGTTTTATCTCCTATGGACTCCTTCCACTGGACTGAAG
ACACTCAATTTGGGAAGCTGTGTGATCGCCACAAACCTTCAGGAAATACGAAATGGATTTTCT
GAGATACGGGGCAGTGTGCAAGCCAAAGATGGAAACATTGACATCAGAATCTTAAGGAGGACT
GAGTCTTTGCAAGACACAAAGCCTGCGAATCGATGCTGCCTCCTGCGCCATTTGCTAAGACTC
TATCTGGACAGGGTATTTAAAAACTACCAGACCCCTGACCATTATACTCTCCGGAAGATCAGC
AGCCTCGCCAATTCCTTTCTTACCATCAAGAAGGACCTCCGGCTCTCTCATGCCCACATGACA
TGCCATTGTGGGGAGGAAGCAATGAAGAAATACAGCCAGATTCTGAGTCACTTTGAAAAGCTG
GAACCTCAGGCAGCAGTTGTGAAGGCTTTGGGGGAACTAGACATTCTTCTGCAATGGATGGAG
GAGACAGAATAGGAGGAAAGTGATGCTGCTGCTAAGAATATTCGAGGTCAAGAGCTCCAGTCT
TCAATACCTGCAGAGGAGGCATGACCCCAAACCACCATCTCTTTACTGTACTAGTCTTGTGCT
GGTCACAGTGTATCTTATTTATGCATTACTTGCTTCCTTGCATGATTGTCTTTATGCATCCCC
AATCTTAATTGAGACCATACTTGTATAAGATTTTGTAATATCTTTCTGCTATTGGATATATT
TATTAGTTAATATATTTATTTATTTTTGCTATTTAATGTATTTATTTTTTACTTGGACATG
AAACTTTAAAAAAATTCACAGATTATATTTATAACCTGACTAGAGCAGGTGATGTATTTTAT
ACAGTAAAAAAAAAAAACCTTGTAAATTCTAGAAGAGTGGCTAGGGGGGTTATTCATTTGTAT
TCAACTAAGGACATATTTACTCATGCTGATGCTCTGTGAGATATTTGAAATTGAACCAATGAC
TACTTAGGATGGGTTGTGGAATAAGTTTTGATGTGGAATTGCACATCTACCTTACAATTACTG
ACCATCCCCAGTAGACTCCCCAGTCCCATAATTGTGTATCTTCCAGCCAGGAATCCTACACGG
CCAGCATGTATTTCTACAAATAAGTTTTCTTTGCATACCAAAAAAAAAAAAAAAAAAA
```

FIGURE 546

MRQFPKTSFDISPEMSFSIYSLQVPAVPGLTCWALTAEPGWGQNKGATTCATNSHSDSELRPE
IFSSREAWQFFLLLWSPDFRPKMKASSLAFSLLSAAFYLLWTPSTGLKTLNLGSCVIATNLQE
IRNGFSEIRGSVQAKDGNIDIRILRRTESLQDTKPANRCCLLRHLLRLYLDRVFKNYQTPDHY
TLRKISSLANSFLTIKKDLRLSHAHMTCHCGEEAMKKYSQILSHFEKLEPQAAVVKALGELDI
LLQWMEETE

Important features:

Signal peptide:

amino acids 1-42 cAMP- and cGMP-dependent protein kinase phosphorylation sites.

amino acids 192-195, 225-228

N-myristoylation sites.

amino acids 42-47, 46-51, 136-141

FIGURE 547

AGCAACTCAAGTTCATCATTGTCCTGAGAGAGAGGAGCAGCGCGGTTCTCGGCCGGGACAGCA
GAACGCCAGGGGACCCTCACCTGGGCGCGCCGGGGCACGGGCTTTGATTGTCCTGGGGTCGCG
GAGACCCGCGCGCCTGCCCTGCACGCCGGGCGGCAACCTTTGCAGTCGCGTTGGCTGCTGCGA
TCGGCCGGCGGGTCCCTGCCGAAGGCTCGGCTGCTTCTGTCCACCTCTTACACTTCTTCATTT
ATCGGTGGATCATTTCGAGAGTCCGTCTTGTAA<u>ATG</u>TTTGGCACTTTGCTACTTTATTGCTTC
TTTCTGGCGACAGTTCCAGCACTCGCCGAGACCGGCGGAGAAAGGCAGCTGAGCCCGGAGAAG
AGCGAAATATGGGGACCCGGGCTAAAAGCAGACGTCGTCCTTCCCGCCCGCTATTTCTATATT
CAGGCAGTGGATACATCAGGGAATAAATTCACATCTTCTCCAGGCGAAAAGGTCTTCCAGGTG
AAAGTCTCAGCACCAGAGGAGCAATTCACTAGAGTTGGAGTCCAGGTTTTAGACCGAAAAGAT
GGGTCCTTCATAGTAAGATACAGAATGTATGCAAGCTACAAAAATCTGAAGGTGGAAATTAAA
TTCCAAGGGCAACATGTGGCCAAATCCCCATATATTTTAAAAGGGCCGGTTTACCATGAGAAC
TGTGACTGTCCTCTGCAAGATAGTGCAGCCTGGCTACGGGAGATGAACTGCCCTGAAACCATT
GCTCAGATTCAGAGAGATCTGGCACATTTCCCTGCTGTGGATCCAGAAAAGATTGCAGTAGAA
ATCCCAAAAAGATTTGGACAGAGGCAGAGCCTATGTCACTACACCTTAAAGGATAACAAGGTT
TATATCAAGACTCATGGTGAACATGTAGGTTTTAGAATTTTCATGGATGCCATACTACTTTCT
TTGACTAGAAAGGTGAAGATGCCAGATGTGGAGCTCTTTGTTAATTTGGGAGACTGGCCTTTG
GAAAAAAGAAATCCAATTCAAACATCCATCCGATCTTTTCCTGGTGTGGCTCCACAGATTCC
AAGGATATCGTGATGCCTACGTACGATTTGACTGATTCTGTTCTGGAAACCATGGGCCGGGTA
AGTCTGGATATGATGTCCGTGCAAGCTAACACGGGTCCTCCCTGGGAAAGCAAAAATTCCACT
GCCGTCTGGAGAGGGCGAGACAGCCGCAAAGAGAGACTCGAGCTGGTTAAACTCAGTAGAAAA
CACCCAGAACTCATAGACGCTGCTTTCACCAACTTTTTCTTCTTTAAACACGATGAAAACCTG
TATGGTCCCATTGTGAAACATATTTCATTTTTTGATTTCTTCAAGCATAAGTATCAAATAAAT
ATCGATGGCACTGTAGCAGCTTATCGCCTGCCATATTTGCTAGTTGGTGACAGTGTTGTGCTG
AAGCAGGATTCCATCTACTATGAACATTTTACAATGAGCTGCAGCCCTGGAAACACTACATT
CCAGTTAAGAGCAACCTGAGCGATCTGCTAGAAAAACTTAAATGGGCGAAAGATCACGATGAA
GAGGCCAAAAAGATAGCAAAAGCAGGACAAGAATTTGCAAGAAATAATCTCATGGGCGATGAC
ATATTCTGTTATTATTTCAAACTTTTCCAGGAATATGCCAATTTACAAGTGAGTGAGCCCCAA
ATCCGAGAGGGCATGAAAAGGGTAGAACCACAGACTGAGGACGACCTCTTCCCTTGTACTTGC
CATAGGAAAAAGACCAAAGATGAACTC<u>TGA</u>TATGCAAAATAACTTCTATTAGAATAATGGTGC
TCTGAAGACTCTTCTTAACTAAAAGAAGAATTTTTTAAGTATTAATTCCATGGACAATATA
AAATCTGTGTGATTGTTTGCAGTATGAAGACACATTTCTACTTATGCAGTATTCTCATGACTG
TACTTTAAAGTACATTTTTAGAATTTTATAATAAAACCACCTTTATTTTAAAGGAAAAAAA

FIGURE 548

MFGTLLLYCFFLATVPALAETGGERQLSPEKSEIWGPGLKADVVLPARYFYIQAVDTSGNKFT
SSPGEKVFQVKVSAPEEQFTRVGVQVLDRKDGSFIVRYRMYASYKNLKVEIKFQGQHVAKSPY
ILKGPVYHENCDCPLQDSAAWLREMNCPETIAQIQRDLAHFPAVDPEKIAVEIPKRFGQRQSL
CHYTLKDNKVYIKTHGEHVGFRIFMDAILLSLTRKVKMPDVELFVNLGDWPLEKKKSNSNIHP
IFSWCGSTDSKDIVMPTYDLTDSVLETMGRVSLDMMSVQANTGPPWESKNSTAVWRGRDSRKE
RLELVKLSRKHPELIDAAFTNFFFFKHDENLYGPIVKHISFFDFFKHKYQINIDGTVAAYRLP
YLLVGDSVVLKQDSIYYEHFYNELQPWKHYIPVKSNLSDLLEKLKWAKDHDEEAKKIAKAGQE
FARNNLMGDDIFCYYFKLFQEYANLQVSEPQIREGMKRVEPQTEDDLFPCTCHRKKTKDEL

Important features:
Signal peptide:
amino acids 1-17

N-glycosylation sites.
amino acids 302-306, 414-418 cAMP- and cGMP-dependent protein kinase phosphorylation sites.
amino acids 243-247, 495-499

Tyrosine kinase phosphorylation site.
amino acids 341-348

N-myristoylation sites.
amino acids 59-65, 118-124, 184-190, 258-264, 370-376, 439-445

Endoplasmic reticulum targeting sequence.
amino acids 499-504

FIGURE 549

GGGTGATTGAACTAAACCTTCGCCGCACCGAGTTTGCAGTACGGCCGTCACCCGCACCGCTGC
CTGCTTGCGGTTGGAGAAATCAAGGCCCTACCGGGCCTCCGTAGTCACCTCTCTATAGTGGGC
GTGGCCGAGGCCGGGGTGACCCTGCCGGAGCCTCCGCTGCCAGCGACATGTTCAAGGTAATTC
AGAGGTCCGTGGGGCCAGCCAGCCTGAGCTTGCTCACCTTCAAAGTCTATGCAGCACCAAAAA
AGGACTCACCTCCCAAAAATTCCGTGAAGGTTGATGAGCTTTCACTCTACTCAGTTCCTGAGG
GTCAATCGAAGTATGTGGAGGAGGCAAGGAGCCAGCTTGAAGAAAGCATCTCACAGCTCCGAC
ACTATTGCGAGCCATACACAACCTGGTGTCAGGAAACGTACTCCCAAACTAAGCCCAAGATGC
AAAGTTTGGTTCAATGGGGGTTAGACAGCTATGACTATCTCCAAAATGCACCTCCTGGATTTT
TTCCGAGACTTGGTGTTATTGGTTTTGCTGGCCTTATTGGACTCCTTTTGGCTAGAGGTTCAA
AAATAAAGAAGCTAGTGTATCCGCCTGGTTTCATGGGATTAGCTGCCTCCCTCTATTATCCAC
AACAAGCCATCGTGTTTGCCCAGGTCAGTGGGGAGAGATTATATGACTGGGGTTTACGAGGAT
ATATAGTCATAGAAGATTTGTGGAAGGAGAACTTTCAAAAGCCAGGAAATGTGAAGAATTCAC
CTGGAACTAAGTAGAAAACTCCATGCTCTGCCATCTTAATCAGTTATAGGTAAACATTGGAAA
CTCCATAGAATAAATCAGTATTTCTACAGAAAAATGGCATAGAAGTCAGTATTGAATGTATTA
AATTGGCTTTCTTCTTCAGGAAAAACTAGACCAGACCTCTGTTATCTTCTGTGAAATCATCCT
ACAAGCAAACTAACCTGGAATCCCTTCACCTAGAGATAATGTACAAGCCTTAGAACTCCTCAT
TCTCATGTTGCTATTTATGTACCTAATTAAAACCCAAGTTTAAAAAAAAAAAAAAAAAAAAAA
AAAAAAAAAAAAAAAA

FIGURE 550

MFKVIQRSVGPASLSLLTFKVYAAPKKDSPPKNSVKVDELSLYSVPEGQSKYVEEARSQLEES
ISQLRHYCEPYTTWCQETYSQTKPKMQSLVQWGLDSYDYLQNAPPGFFPRLGVIGFAGLIGLL
LARGSKIKKLVYPPGFMGLAASLYYPQQAIVFAQVSGERLYDWGLRGYIVIEDLWKENFQKPG
NVKNSPGTK

Important features:

Signal peptide:

Amino acids 1-23

Transmembrane domain:

Amino acids 111-130 cAMP- and cGMP-dependent protein kinase phosphorylation site:

Amino acids 26-30

Tyrosine kinase phosphorylation site:

Amino acids 36-44

N-myristoylation sites:

Amino acids 124-130;144-150;189-195

PRO536 POLYPEPTIDES

RELATED APPLICATIONS

This application is a continuation of, and claims priority under 35 USC §120 to, U.S. application Ser. No. 10/028,072 filed Dec. 19, 2001, now abandoned which is a continuation of, and claims priority under 35 USC §120 to, PCT Application PCT/US00/32678 filed Dec. 1, 2000, which is a continuation-in-part of, and claims priority under 35 USC §120 to, PCT Application PCT/US00/08439 filed Mar. 30, 2000, which claims priority under 35 USC §119 to U.S. Provisional Application 60/146,222 filed Jul. 28, 1999, where PCT Application PCT/US00/08439 is a continuation-in-part of, and claims priority under 35 USC §120 to, U.S. application Ser. No. 09/380,137 filed Aug. 25, 1999, which is a continuation-in-part of, and claims priority under 35 USC §120 to, PCT Application PCT/US99/12252 filed Jun. 2, 1999, which claims priority under 35 USC §119 to U.S. Provisional Application 60/090,349 filed Jun. 23, 1998.

FIELD OF THE INVENTION

The present invention relates generally to the identification and isolation of novel DNA and to the recombinant production of novel polypeptides.

BACKGROUND OF THE INVENTION

Extracellular proteins play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108-7113 (1996); U.S. Pat. No. 5,536,637)].

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesion molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Efforts are being undertaken by both industry and academia to identify new, native receptor or membrane-bound proteins. Many efforts are focused on the screening of mammalian recombinant DNA libraries to identify the coding sequences for novel receptor or membrane-bound proteins.

SUMMARY OF THE INVENTION

In one embodiment, the invention provides an isolated nucleic acid molecule comprising a nucleotide sequence that encodes a PRO polypeptide.

In one aspect, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 10 nucleotides in length, alternatively at least about 15 nucleotides in length, alternatively at least about 20 nucleotides in length, alternatively at least about 30 nucleotides in length, alternatively at least about 40 nucleotides in length, alternatively at least about 50 nucleotides in length, alternatively at least about 60 nucleotides in length, alternatively at least about 70 nucleotides in length, alternatively at least about 80 nucleotides in length, alternatively at least about 90 nucleotides in length, alternatively at least about 100 nucleotides in length, alternatively at least about 110 nucleotides in length, alternatively at least about 120 nucleotides in length, alternatively at least about 130 nucleotides in length, alternatively at least about 140 nucleotides in length, alternatively at least about 150 nucleotides in length, alternatively at least about 160 nucleotides in length, alternatively at least about 170 nucleotides in length, alternatively at least about 180 nucleotides in length, alternatively at least about 190 nucleotides in length, alternatively at least about 200 nucleotides in length, alternatively at least about 250 nucleotides in length, alternatively at least about 300 nucleotides in length, alternatively at least about 350 nucleotides in length, alternatively at least about 400 nucleotides in length, alternatively at least about 450 nucleotides in length, alternatively at least about 500 nucleotides in length, alternatively at least about 600 nucleotides in length, alternatively at least about 700 nucleotides in length, alternatively at least about 800 nucleotides in length, alternatively at least about 900 nucleotides in length and alternatively at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to an amino acid sequence encoded by any of the human protein cDNAs deposited with the ATCC as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO. polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

In other embodiments of the present invention, the invention provides vectors comprising DNA encoding any of the herein described polypeptides. Host cell comprising any such vector are also provided. By way of example, the host cells may be CHO cells, *E. coli*, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which binds, preferably specifically, to any of the above or below described polypeptides. Optionally, the antibody is a monoclonal antibody, humanized antibody, antibody fragment or single-chain antibody.

In yet other embodiments, the invention provides oligonucleotide probes which may be useful for isolating genomic and cDNA nucleotide sequences, measuring or detecting expression of an associated gene or as antisense probes, wherein those probes may be derived from any of the above or below described nucleotide sequences. Preferred probe lengths are described above.

In yet other embodiments, the present invention is directed to methods of using the PRO polypeptides of the present invention for a variety of uses based upon the functional biological assay data presented in the Examples below.

BRIEF DESCRIPTION OF THE DRAWINGS

FIG. 1 shows a nucleotide sequence (SEQ ID NO:1) of a native sequence PRO177 cDNA, wherein SEQ ID NO:1 is a clone designated herein as "DNA16438-1387".

FIG. 2 shows the amino acid sequence (SEQ ID NO:2) derived from the coding sequence of SEQ ID NO:1 shown in FIG. 1.

FIG. 3 shows a nucleotide sequence (SEQ ID NO:3) of a native sequence PRO3574 cDNA, wherein SEQ ID NO:3 is a clone designated herein as "DNA19360-2552".

FIG. 4 shows the amino acid sequence (SEQ ID NO:4) derived from the coding sequence of SEQ ID NO:3 shown in FIG. 3.

FIG. 5 shows a nucleotide sequence (SEQ ID NO:5) of a native sequence PRO1280 cDNA, wherein SEQ ID NO:5 is a clone designated herein as "DNA33455-1548".

FIG. 6 shows the amino acid sequence (SEQ ID NO:6) derived from the coding sequence of SEQ ID NO:5 shown in FIG. 5.

FIG. 7 shows a nucleotide sequence (SEQ ID NO:7) of a native sequence PRO4984 cDNA, wherein SEQ ID NO:7 is a clone designated herein as "DNA37155-2651".

FIG. 8 shows the amino acid sequence (SEQ ID NO:8) derived from the coding sequence of SEQ ID NO:7 shown in FIG. 7.

FIG. 9 shows a nucleotide sequence (SEQ ID NO:9) of a native sequence PRO4988 cDNA, wherein SEQ ID NO:9 is a clone designated herein as "DNA38269-2654".

FIG. 10 shows the amino acid sequence (SEQ ID NO:10) derived from the coding sequence of SEQ ID NO:9 shown in FIG. 9.

FIG. 11 shows a nucleotide sequence (SEQ ID NO:11) of a native sequence PRO305 cDNA, wherein SEQ ID NO:11 is a clone designated herein as "DNA40619-1220".

FIG. 12 shows the amino acid sequence (SEQ ID NO:12) derived from the coding sequence of SEQ ID NO:11 shown in FIG. 11.

FIG. 13 shows a nucleotide sequence (SEQ ID NO:13) of a native sequence PRO1866 cDNA, wherein SEQ ID NO:13 is a clone designated herein as "DNA44174-2513".

FIG. 14 shows the amino acid sequence (SEQ ID NO:14) derived from the coding sequence of SEQ ID NO:13 shown in FIG. 13.

FIG. 15 shows a nucleotide sequence (SEQ ID NO:15) of a native sequence PRO4996 cDNA, wherein SEQ ID NO:15 is a clone designated herein as "DNA44675-2662".

FIG. 16 shows the amino acid sequence (SEQ ID NO:16) derived from the coding sequence of SEQ ID NO:15 shown in FIG. 15.

FIG. 17 shows a nucleotide sequence (SEQ ID NO:17) of a native sequence PRO4406 cDNA, wherein SEQ ID NO:17 is a clone designated herein as "DNA45408-2615".

FIG. 18 shows the amino acid sequence (SEQ ID NO:18) derived from the coding sequence of SEQ ID NO:17 shown in FIG. 17.

FIG. 19 shows a nucleotide sequence (SEQ ID NO:19) of a native sequence PRO1120 cDNA, wherein SEQ ID NO:19 is a clone designated herein as "DNA48606-1479".

FIG. 20 shows the amino acid sequence (SEQ ID NO:20) derived from the coding sequence of SEQ ID NO:19 shown in FIG. 19.

FIG. 21 shows a nucleotide sequence (SEQ ID NO:21) of a native sequence PRO4990 cDNA, wherein SEQ ID NO:21 is a clone designated herein as "DNA52753-2656".

FIG. 22 shows the amino acid sequence (SEQ ID NO:22) derived from the coding sequence of SEQ ID NO:21 shown in FIG. 21.

FIG. 23 shows a nucleotide sequence (SEQ ID NO:23) of a native sequence PRO738 cDNA, wherein SEQ ID NO:23 is a clone designated herein as "DNA53915-1258".

FIG. 24 shows the amino acid sequence (SEQ ID NO:24) derived from the coding sequence of SEQ ID NO:23 shown in FIG. 23.

FIG. 25 shows a nucleotide sequence (SEQ ID NO:25) of a native sequence PRO3577 cDNA, wherein SEQ ID NO:25 is a clone designated herein as "DNA53991-2553".

FIG. 26 shows the amino acid sequence (SEQ ID NO:26) derived from the coding sequence of SEQ ID NO:25 shown in FIG. 25.

FIG. 27 shows a nucleotide sequence (SEQ ID NO:27) of a native sequence PRO1879 cDNA, wherein SEQ ID NO:27 is a clone designated herein as "DNA54009-2517".

FIG. 28 shows the amino acid sequence (SEQ ID NO:28) derived from the coding sequence of SEQ ID NO:27 shown in FIG. 27.

FIG. 29 shows a nucleotide sequence (SEQ ID NO:29) of a native sequence PRO1471 cDNA, wherein SEQ ID NO:29 is a clone designated herein as "DNA56055-1643".

FIG. 30 shows the amino acid sequence (SEQ ID NO:30) derived from the coding sequence of SEQ ID NO:29 shown in FIG. 29.

FIG. 31 shows a nucleotide sequence (SEQ ID NO:31) of a native sequence PRO 1114 cDNA, wherein SEQ ID NO:31 is a clone designated herein as "DNA57033-1403".

FIG. 32 shows the amino acid sequence (SEQ ID NO:32) derived from the coding sequence of SEQ ID NO:31 shown in FIG. 31.

FIG. 33 shows a nucleotide sequence (SEQ ID NO:33) of a native sequence PRO1076 cDNA, wherein SEQ ID NO:33 is a clone designated herein as "DNA57252-1453".

FIG. 34 shows the amino acid sequence (SEQ ID NO:34) derived from the coding sequence of SEQ ID NO:33 shown in FIG. 33.

FIG. 35 shows a nucleotide sequence (SEQ ID NO:35) of a native sequence PRO1483 cDNA, wherein SEQ ID NO:35 is a clone designated herein as "DNA58799-1652".

FIG. 36 shows the amino acid sequence (SEQ ID NO:36) derived from the coding sequence of SEQ ID NO:35 shown in FIG. 35.

FIG. 37 shows a nucleotide sequence (SEQ ID NO:37) of a native sequence PRO4985 cDNA, wherein SEQ ID NO:37 is a clone designated herein as "DNA59770-2652".

FIG. 38 shows the amino acid sequence (SEQ ID NO:38) derived from the coding sequence of SEQ ID NO:37 shown in FIG. 37.

FIG. 39 shows a nucleotide sequence (SEQ ID NO:39) of a native sequence PRO5000 cDNA, wherein SEQ ID NO:39 is a clone designated herein as "DNA59774-2665".

FIG. 40 shows the amino acid sequence (SEQ ID NO:40) derived from the coding sequence of SEQ ID NO:39 shown in FIG. 39.

FIG. 41 shows a nucleotide sequence (SEQ ID NO:41) of a native sequence PRO1881 cDNA, wherein SEQ ID NO:41 is a clone designated herein as "DNA60281-2518".

FIG. 42 shows the amino acid sequence (SEQ ID NO:42) derived from the coding sequence of SEQ ID NO:41 shown in FIG. 41.

FIG. 43 shows a nucleotide sequence (SEQ ID NO:43) of a native sequence PRO4314 cDNA, wherein SEQ ID NO:43 is a clone designated herein as "DNA60736-2559".

FIG. 44 shows the amino acid sequence (SEQ ID NO:44) derived from the coding sequence of SEQ ID NO:43 shown in FIG. 43.

FIG. 45 shows a nucleotide sequence (SEQ ID NO:45) of a native sequence PRO4987 cDNA, wherein SEQ ID NO:45 is a clone designated herein as "DNA61875-2653".

FIG. 46 shows the amino acid sequence (SEQ ID NO:46) derived from the coding sequence of SEQ ID NO:45 shown in FIG. 45.

FIG. 47 shows a nucleotide Sequence (SEQ ID NO:47) of a native sequence PRO4313 cDNA, wherein SEQ ID NO:47 is a clone designated herein as "DNA62312-2558".

FIG. 48 shows the amino acid sequence (SEQ ID NO:48) derived from the coding sequence of SEQ ID NO:47 shown in FIG. 47.

FIG. 49 shows a nucleotide sequence (SEQ ID NO:49) of a native sequence PRO4799 cDNA, wherein SEQ ID NO:49 is a clone designated herein as "DNA62849-1604".

FIG. 50 shows the amino acid sequence (SEQ ID NO:50) derived from the coding sequence of SEQ ID NO:49 shown in FIG. 49.

FIG. 51 shows a nucleotide sequence (SEQ ID NO:51) of a native sequence PRO4995 cDNA, wherein SEQ ID NO:51 is a clone designated herein as "DNA66307-2661".

FIG. 52 shows the amino acid sequence (SEQ ID NO:52) derived from the coding sequence of SEQ ID NO:51 shown in FIG. 51.

FIG. 53 shows a nucleotide sequence.(SEQ ID NO:53) of a native sequence PRO1341 cDNA, wherein SEQ ID NO:53 is a clone designated herein as "DNA66677-2535".

FIG. 54 shows the amino acid sequence (SEQ ID NO:54) derived from the coding sequence of SEQ ID NO:53 shown in FIG. 53.

FIG. 55 shows a nucleotide sequence (SEQ ID NO:55) of a native sequence PRO1777 cDNA, wherein SEQ ID NO:55 is a clone designated herein as "DNA71235-1706".

FIG. 56 shows the amino acid sequence (SEQ ID NO:56) derived from the coding sequence of SEQ ID NO:55 shown in FIG. 55.

FIG. 57 shows a nucleotide sequence (SEQ ID NO:57) of a native sequence PRO3580 cDNA, wherein SEQ ID NO:57 is a clone designated herein as "DNA71289-2547".

FIG. 58 shows the amino acid sequence (SEQ ID NO:58) derived from the coding sequence of SEQ ID NO:57 shown in FIG. 57.

FIG. 59 shows a nucleotide sequence (SEQ ID NO:59) of a native sequence PRO1779 cDNA, wherein SEQ ID NO:59 is a clone designated herein as "DNA73775-1707".

FIG. 60 shows the amino acid sequence (SEQ ID NO:60) derived from the coding sequence of SEQ ID NO:59 shown in FIG. 59.

FIG. 61 shows a nucleotide sequence (SEQ ID NO:61) of a native sequence PRO1754 cDNA, wherein SEQ ID NO:61 is a clone designated herein as "DNA76385-1692".

FIG. 62 shows the amino acid sequence (SEQ ID NO:62) derived from the coding sequence of SEQ ID NO:61 shown in FIG. 61.

FIG. 63 shows a nucleotide sequence (SEQ ID NO:63) of a native sequence PRO1906 cDNA, wherein SEQ ID NO:63 is a clone designated herein as "DNA76395-2527".

FIG. 64 shows the amino acid sequence (SEQ ID NO:64) derived from the coding sequence of SEQ ID NO:63 shown in FIG. 63.

FIG. 65 shows a nucleotide sequence (SEQ ID NO:65) of a native sequence PRO1870 cDNA, wherein SEQ ID NO:65 is a clone designated herein as "DNA77622-2516".

FIG. 66 shows the amino acid sequence (SEQ ID NO:66) derived from the coding sequence of SEQ ID NO:65 shown in FIG. 65.

FIG. 67 shows a nucleotide sequence (SEQ ID NO:67) of a native sequence PRO4329 cDNA, wherein SEQ ID NO:67 is a clone designated herein as "DNA77629-2573".

FIG. 68 shows the amino acid sequence (SEQ ID NO:68) derived from the coding sequence of SEQ ID NO:67 shown in FIG. 67.

FIG. 69 shows a nucleotide sequence (SEQ ID NO:69) of a native sequence PRO4979 cDNA, wherein SEQ ID NO:69 is a clone designated herein as "DNA77645-2648".

FIG. 70 shows the amino acid sequence (SEQ ID NO:70) derived from the coding sequence of SEQ ID NO:69 shown in FIG. 69.

FIG. 71 shows a nucleotide sequence (SEQ ID NO:71) of a native sequence PRO1885 cDNA, wherein SEQ ID NO:71 is a clone designated herein as "DNA79302-2521".

FIG. 72 shows the amino acid sequence (SEQ ID NO:72) derived from the coding sequence of SEQ ID NO:71 shown in FIG. 71.

FIG. 73 shows a nucleotide sequence (SEQ ID NO:73) of a native sequence PRO1882 cDNA, wherein SEQ ID NO:73 is a clone designated herein as "DNA79865-2519".

FIG. 74 shows the amino acid sequence (SEQ ID NO:74) derived from the coding sequence of SEQ ID NO:73 shown in FIG. 73.

FIG. 75 shows a nucleotide sequence (SEQ ID NO:75) of a native sequence PRO4989 cDNA, wherein SEQ ID NO:75 is a clone designated herein as "DNA80135-2655".

FIG. 76 shows the amino acid sequence (SEQ ID NO:76) derived from the coding sequence of SEQ ID NO:75 shown in FIG. 75.

FIG. 77 shows a nucleotide sequence (SEQ ID NO:77) of a native sequence PRO4323 cDNA, wherein SEQ ID NO:77 is a clone designated herein as "DNA80794-2568".

FIG. 78 shows the amino acid sequence (SEQ ID NO:78) derived from the coding sequence of SEQ ID NO:77 shown in FIG. 77.

FIG. 79 shows a nucleotide sequence (SEQ ID NO:79) of a native sequence PRO1886 cDNA, wherein SEQ ID NO:79 is a clone designated herein as "DNA80796-2523".

FIG. 80 shows the amino acid sequence (SEQ ID NO:80) derived from the coding sequence of SEQ ID NO:79 shown in FIG. 79.

FIG. 81 shows a nucleotide sequence (SEQ ID NO:81) of a native sequence PRO4395 cDNA, wherein SEQ ID NO:81 is a clone designated herein as "DNA80840-2605".

FIG. 82 shows the amino acid sequence (SEQ ID NO:82) derived from the coding sequence of SEQ ID NO:81 shown in FIG. 81.

FIG. 83 shows a nucleotide sequence (SEQ ID NO:83) of a native sequence PRO1782 cDNA, wherein SEQ ID NO:83 is a clone designated herein as "DNA80899-2501".

FIG. 84 shows the amino acid sequence (SEQ ID NO:84) derived from the coding sequence of SEQ ID NO:83 shown in FIG. 83.

FIG. 85 shows a nucleotide sequence (SEQ ID NO:85) of a native sequence PRO4338 cDNA, wherein SEQ ID NO:85 is a clone designated herein as "DNA81228-2580".

FIG. 86 shows the amino acid sequence (SEQ ID NO:86) derived from the coding sequence of SEQ ID NO:85 shown in FIG. 85.

FIG. 87 shows a nucleotide sequence (SEQ ID NO:87) of a native sequence PRO4341 cDNA, wherein SEQ ID NO:87 is a clone designated herein as "DNA81761-2583".

FIG. 88 shows the amino acid sequence (SEQ ID NO:88) derived from the coding sequence of SEQ ID NO:87 shown in FIG. 87.

FIG. 89 shows a nucleotide sequence (SEQ ID NO:89) of a native sequence PRO5990 cDNA, wherein SEQ ID NO:89 is a clone designated herein as "DNA96042-2682".

FIG. 90 shows the amino acid sequence (SEQ ID NO:90) derived from the coding sequence of SEQ ID NO:89 shown in FIG. 89.

FIG. 91 shows a nucleotide sequence (SEQ ID NO:91) of a native sequence PRO3438 cDNA, wherein SEQ ID NO:91 is a clone designated herein as "DNA82364-2538".

FIG. 92 shows the amino acid sequence (SEQ ID NO:92) derived from the coding sequence of SEQ ID NO:91 shown in FIG. 91.

FIG. 93 shows a nucleotide sequence (SEQ ID NO:93) of a native sequence PRO4321 cDNA, wherein SEQ ID NO:93 is a clone designated herein as "DNA82424-2566".

FIG. 94 shows the amino acid sequence (SEQ ID NO:94) derived from the coding sequence of SEQ ID NO:93 shown in FIG. 93.

FIG. 95 shows a nucleotide sequence (SEQ ID NO:95) of a native sequence PRO4304 cDNA, wherein SEQ ID NO:95 is a clone designated herein as "DNA82430-2557".

FIG. 96 shows the amino acid sequence (SEQ ID NO:96) derived from the coding sequence of SEQ ID NO:95 shown in FIG. 95.

FIG. 97 shows a nucleotide sequence (SEQ ID NO:97) of a native sequence PRO1801 cDNA, wherein SEQ ID NO:97 is a clone designated herein as "DNA83500-2506".

FIG. 98 shows the amino acid sequence (SEQ ID NO:98) derived from the coding sequence of SEQ ID NO:97 shown in FIG. 97.

FIG. 99 shows a nucleotide sequence (SEQ ID NO:99) of a native sequence PRO4403 cDNA, wherein SEQ ID NO:99 is a clone designated herein as "DNA83509-2612".

FIG. 100 shows the amino acid sequence (SEQ ID NO:100) derived from the coding sequence of SEQ ID NO:99 shown in FIG. 99.

FIG. 101 shows a nucleotide sequence (SEQ ID NO:101) of a native sequence PRO4324 cDNA, wherein SEQ ID NO:101 is a clone designated herein as "DNA83560-2569".

FIG. 102 shows the amino acid sequence (SEQ ID NO:102) derived from the coding sequence of SEQ ID NO:101 shown in FIG. 101.

FIG. 103 shows a nucleotide sequence (SEQ ID NO:103) of a native sequence PRO4303 cDNA, wherein SEQ ID NO:103 is a clone designated herein as "DNA84139-2555".

FIG. 104 shows the amino acid sequence (SEQ ID NO:104) derived from the coding sequence of SEQ ID NO:103 shown in FIG. 103.

FIG. 105 shows a nucleotide sequence (SEQ ID NO:105) of a native sequence PRO4305 cDNA, wherein SEQ ID NO:105 is a clone designated herein as "DNA84141-2556".

FIG. 106 shows the amino acid sequence (SEQ ID NO:106) derived from the coding sequence of SEQ ID NO:105 shown in FIG. 105.

FIG. 107 shows a nucleotide sequence (SEQ ID NO:107) of a native sequence PRO4404 cDNA, wherein SEQ ID NO:107 is a clone designated herein as "DNA84142-2613".

FIG. 108 shows the amino acid sequence (SEQ ID NO:108) derived from the coding sequence of SEQ ID NO:107 shown in FIG. 107.

FIG. 109 shows a nucleotide sequence (SEQ ID NO:109) of a native sequence PRO1884 cDNA, wherein SEQ ID NO:109 is a clone designated herein as "DNA84318-2520".

FIG. 110 shows the amino acid sequence (SEQ ID NO:110) derived from the coding sequence of SEQ ID NO:109 shown in FIG. 109.

FIG. 111 shows a nucleotide sequence (SEQ ID NO:111) of a native sequence PRO4349 cDNA, wherein SEQ ID NO:111 is a clone designated herein as "DNA84909-2590".

FIG. 112 shows the amino acid sequence (SEQ ID NO:112) derived from the coding sequence of SEQ ID NO:111 shown in FIG. 111.

FIG. 113 shows a nucleotide sequence (SEQ ID NO:113) of a native sequence PRO4401 cDNA, wherein SEQ ID NO:113 is a clone designated herein as "DNA84912-2610".

FIG. 114 shows the amino acid sequence (SEQ ID NO:114) derived from the coding sequence of SEQ ID NO:113 shown in FIG. 113.

FIG. 115 shows a nucleotide sequence (SEQ ID NO:115) of a native sequence PRO1867 cDNA, wherein SEQ ID NO:115 is a clone designated herein as "DNA84925-2514".

FIG. 116 shows the amino acid sequence (SEQ ID NO:116) derived from the coding sequence of SEQ ID NO:115 shown in FIG. 115.

FIG. 117 shows a nucleotide sequence (SEQ ID NO:117) of a native sequence PRO4319 cDNA, wherein SEQ ID NO:117 is a clone designated herein as "DNA84928-2564".

FIG. 118 shows the amino acid sequence (SEQ ID NO:118) derived from the coding sequence of SEQ ID NO:117 shown in FIG. 117.

FIG. 119 shows a nucleotide sequence (SEQ ID NO:119) of a native sequence PRO4991 cDNA, wherein SEQ ID NO:119 is a clone designated herein as "DNA84932-2657".

FIG. 120 shows the amino acid sequence (SEQ ID NO:120) derived from the coding sequence of SEQ ID NO:119 shown in FIG. 119.

FIG. 121 shows a nucleotide sequence (SEQ ID NO:121) of a native sequence PRO4398 cDNA, wherein SEQ ID NO:121 is a clone designated herein as "DNA86592-2607".

FIG. 122 shows the amino acid sequence (SEQ ID NO:122) derived from the coding sequence of SEQ ID NO:121 shown in FIG. 121.

FIG. 123 shows a nucleotide sequence (SEQ ID NO:123) of a native sequence PRO4346 cDNA, wherein SEQ ID NO:123 is a clone designated herein as "DNA86594-2587".

FIG. 124 shows the amino acid sequence (SEQ ID NO:124) derived from the coding sequence of SEQ ID NO:123 shown in FIG. 123.

FIG. 125 shows a nucleotide sequence (SEQ ID NO:125) of a native sequence PRO4350 cDNA, wherein SEQ ID NO:125 is a clone designated herein as "DNA86647-2591".

FIG. 126 shows the amino acid sequence (SEQ ID NO:126) derived from the coding sequence of SEQ ID NO:125 shown in FIG. 125.

FIG. 127 shows a nucleotide sequence (SEQ ID NO:127) of a native sequence PRO4318 cDNA, wherein SEQ ID NO:127 is a clone designated herein as "DNA87185-2563".

FIG. 128 shows the amino acid sequence (SEQ ID NO:128) derived from the coding sequence of SEQ ID NO:127 shown in FIG. 127.

FIG. 129 shows a nucleotide sequence (SEQ ID NO:129) of a native sequence PRO4340 cDNA, wherein SEQ ID NO:129 is a clone designated herein as "DNA87656-2582".

FIG. 130 shows the amino acid sequence (SEQ ID NO:130) derived from the coding sequence of SEQ ID NO:129 shown in FIG. 129.

FIG. 131 shows a nucleotide sequence (SEQ ID NO:131) of a native sequence PRO4400 cDNA, wherein SEQ ID NO:131 is a clone designated herein as "DNA87974-2609".

FIG. 132 shows the amino acid sequence (SEQ ID NO:132) derived from the coding sequence of SEQ ID NO:131 shown in FIG. 131.

FIG. 133 shows a nucleotide sequence (SEQ ID NO:133) of a native sequence PRO4320 cDNA, wherein SEQ ID NO:133 is a clone designated herein as "DNA88001-2565".

FIG. 134 shows the amino acid sequence (SEQ ID NO:134) derived from the coding sequence of SEQ ID NO:133 shown in FIG. 133.

FIG. 135 shows a nucleotide sequence (SEQ ID NO:135) of a native sequence PRO4409 cDNA, wherein SEQ ID NO:135 is a clone designated herein as "DNA88004-2575".

FIG. 136 shows the amino acid sequence (SEQ ID NO:136) derived from the coding sequence of SEQ ID NO:135 shown in FIG. 135.

FIG. 137 shows a nucleotide sequence (SEQ ID NO:137) of a native sequence PRO4399 cDNA, wherein SEQ ID NO:137 is a clone designated herein as "DNA89220-2608".

FIG. 138 shows the amino acid sequence (SEQ ID NO:138) derived from the coding sequence of SEQ ID NO:137 shown in FIG. 137.

FIG. 139 shows a nucleotide sequence (SEQ ID NO:139) of a native sequence PRO4418 cDNA, wherein SEQ ID NO:139 is a clone designated herein as "DNA89947-2618".

FIG. 140 shows the amino acid sequence (SEQ ID NO:140) derived from the coding sequence of SEQ ID NO:139 shown in FIG. 139.

FIG. 141 shows a nucleotide sequence (SEQ ID NO:141) of a native sequence PRO4330 cDNA, wherein SEQ ID NO:141 is a clone designated herein as "DNA90842-2574".

FIG. 142 shows the amino acid sequence (SEQ ID NO:142) derived from the coding sequence of SEQ ID NO:141 shown in FIG. 141.

FIG. 143 shows a nucleotide sequence (SEQ ID NO:143) of a native sequence PRO4339 cDNA, wherein SEQ ID NO:143 is a clone designated herein as "DNA91775-2581".

FIG. 144 shows the amino acid sequence (SEQ ID NO:144) derived from the coding sequence of SEQ ID NO:143 shown in FIG. 143.

FIG. 145 shows a nucleotide sequence (SEQ ID NO:145) of a native sequence PRO4326 cDNA, wherein SEQ ID NO:145 is a clone designated herein as "DNA91779-2571".

FIG. 146 shows the amino acid sequence (SEQ ID NO:146) derived from the coding sequence of SEQ ID NO:145 shown in FIG. 145.

FIG. 147 shows a nucleotide sequence (SEQ ID NO:147) of a native sequence PRO6014 cDNA, wherein SEQ ID NO:147 is a clone designated herein as "DNA92217-2697".

FIG. 148 shows the amino acid sequence (SEQ ID NO:148) derived from the coding sequence of SEQ ID NO:147 shown in FIG. 147.

FIG. 149 shows a nucleotide sequence (SEQ ID NO:149) of a native sequence PRO3446 cDNA, wherein SEQ ID NO:149 is a clone designated herein as "DNA92219-2541".

FIG. 150 shows the amino acid sequence (SEQ ID NO:150) derived from the coding sequence of SEQ ID NO:149 shown in FIG. 149.

FIG. 151 shows a nucleotide sequence (SEQ ID NO:151) of a native sequence PRO4322 cDNA, wherein SEQ ID NO:151 is a clone designated herein as "DNA92223-2567".

FIG. 152 shows the amino acid sequence (SEQ ID NO:152) derived from the coding sequence of SEQ ID NO:151 shown in FIG. 151.

FIG. 153 shows a nucleotide sequence (SEQ ID NO:153) of a native sequence PRO4381 cDNA, wherein SEQ ID NO:153 is a clone designated herein as "DNA92225-2603".

FIG. 154 shows the amino acid sequence (SEQ ID NO:154) derived from the coding sequence of SEQ ID NO:153 shown in FIG. 153.

FIG. 155 shows a nucleotide sequence (SEQ ID NO:155) of a native sequence PRO4348 cDNA, wherein SEQ ID NO:155 is a clone designated herein as "DNA92232-2589".

FIG. 156 shows the amino acid sequence (SEQ ID NO:156) derived from the coding sequence of SEQ ID NO:155 shown in FIG. 155.

FIG. 157 shows a nucleotide sequence (SEQ ID NO:157) of a native sequence PRO4371 cDNA, wherein SEQ ID NO:157 is a clone designated herein as "DNA92233-2599".

FIG. 158 shows the amino acid sequence (SEQ ID NO:158) derived from the coding sequence of SEQ ID NO:157 shown in FIG. 157.

FIG. 159 shows a nucleotide sequence (SEQ ID NO:159) of a native sequence PRO3742 cDNA, wherein SEQ ID NO:159 is a clone designated herein as "DNA92243-2549".

FIG. 160 shows the amino acid sequence (SEQ ID NO:160) derived from the coding sequence of SEQ ID NO:159 shown in FIG. 159.

FIG. 161 shows a nucleotide sequence (SEQ ID NO:161) of a native sequence PRO5773 cDNA, wherein SEQ ID NO:161 is a clone designated herein as "DNA92253-2671".

FIG. 162 shows the amino acid sequence (SEQ ID NO:162) derived from the coding sequence of SEQ ID NO:161 shown in FIG. 161.

FIG. 163 shows a nucleotide sequence (SEQ ID NO:163) of a native sequence PRO5774 cDNA, wherein SEQ ID NO:163 is a clone designated herein as "DNA92254-2672".

FIG. 164 shows the amino acid sequence (SEQ ID NO:164) derived from the coding sequence of SEQ ID NO:163 shown in FIG. 163.

FIG. 165 shows a nucleotide sequence (SEQ ID NO:165) of a native sequence PRO4343 cDNA, wherein SEQ ID NO:165 is a clone designated herein as "DNA92255-2584".

FIG. 166 shows the amino acid sequence (SEQ ID NO:166) derived from the coding sequence of SEQ ID NO:165 shown in FIG. 165.

FIG. 167 shows a nucleotide sequence (SEQ ID NO:167) of a native sequence PRO4325 cDNA, wherein SEQ ID NO:167 is a clone designated herein as "DNA92269-2570".

FIG. 168 shows the amino acid sequence (SEQ ID NO:168) derived from the coding sequence of SEQ ID NO:167 shown in FIG. 167.

FIG. 169 shows a nucleotide sequence (SEQ ID NO:169) of a native sequence PRO4347 cDNA, wherein SEQ ID NO:169 is a clone designated herein as "DNA92288-2588".

FIG. 170 shows the amino acid sequence (SEQ ID NO:170) derived from the coding sequence of SEQ ID NO:169 shown in FIG. 169.

FIG. 171 shows a nucleotide sequence (SEQ ID NO:171) of a native sequence PRO3743 cDNA, wherein SEQ ID NO:171 is a clone designated herein as "DNA92290-2550".

FIG. 172 shows the amino acid sequence (SEQ ID NO:172) derived from the coding sequence of SEQ ID NO:171 shown in FIG. 171.

FIG. 173 shows a nucleotide sequence (SEQ ID NO:173) of a native sequence PRO4426 cDNA, wherein SEQ ID NO:173 is a clone designated herein as "DNA93012-2622".

FIG. 174 shows the amino acid sequence (SEQ ID NO:174) derived from the coding sequence of SEQ ID NO:173 shown in FIG. 173.

FIG. 175 shows a nucleotide sequence (SEQ ID NO:175) of a native sequence PRO4500 cDNA, wherein SEQ ID NO:175 is a clone designated herein as "DNA93020-2642".

FIG. 176 shows the amino acid sequence (SEQ ID NO:176) derived from the coding sequence of SEQ ID NO:175 shown in FIG. 175.

FIG. 177 shows a nucleotide sequence (SEQ ID NO:177) of a native sequence PRO4389 cDNA, wherein SEQ ID NO:177 is a clone designated herein as "DNA94830-2604".

FIG. 178 shows the amino acid sequence (SEQ ID NO:178) derived from the coding sequence of SEQ ID NO:177 shown in FIG. 177.

FIG. 179 shows a nucleotide sequence (SEQ ID NO:179) of a native sequence PRO4337 cDNA, wherein SEQ ID NO:179 is a clone designated herein as "DNA94833-2579".

FIG. 180 shows the amino acid sequence (SEQ ID NO:180) derived from the coding sequence of SEQ ID NO:179 shown in FIG. 179.

FIG. 181 shows a nucleotide sequence (SEQ ID NO:181) of a native sequence PRO4992 cDNA, wherein SEQ ID NO:181 is a clone designated herein as "DNA94838-2658".

FIG. 182 shows the amino acid sequence (SEQ ID NO:182) derived from the coding sequence of SEQ ID NO:181 shown in FIG. 181.

FIG. 183 shows a nucleotide sequence (SEQ ID NO:183) of a native sequence PRO5996 cDNA, wherein SEQ ID NO:183 is a clone designated herein as "DNA94844-2686".

FIG. 184 shows the amino acid sequence (SEQ ID NO:184) derived from the coding sequence of SEQ ID NO:183 shown in FIG. 183.

FIG. 185 shows a nucleotide sequence (SEQ ID NO:185) of a native sequence PRO4345 cDNA, wherein SEQ ID NO:185 is a clone designated herein as "DNA94854-2586".

FIG. 186 shows the amino acid sequence (SEQ ID NO:186) derived from the coding sequence of SEQ ID NO:185 shown in FIG. 185.

FIG. 187 shows a nucleotide sequence (SEQ ID NO:187) of a native sequence PRO4978 cDNA, wherein SEQ ID NO:187 is a clone designated herein as "DNA95930".

FIG. 188 shows the amino acid sequence (SEQ ID NO:188) derived from the coding sequence of SEQ ID NO:187 shown in FIG. 187.

FIG. 189 shows a nucleotide sequence (SEQ ID NO:189) of a native sequence PRO5780 cDNA, wherein SEQ ID NO:189 is a clone designated herein as "DNA96868-2677".

FIG. 190 shows the amino acid sequence (SEQ ID NO:190) derived from the coding sequence of SEQ ID NO:189 shown in FIG. 189.

FIG. 191 shows a nucleotide sequence (SEQ ID NO:191) of a native sequence PRO5992 cDNA, wherein SEQ ID NO:191 is a clone designated herein as "DNA96871-2683".

FIG. 192 shows the amino acid sequence (SEQ ID NO:192) derived from the coding sequence of SEQ ID NO:191 shown in FIG. 191.

FIG. 193 shows a nucleotide sequence (SEQ ID NO:193) of a native sequence PRO4428 cDNA, wherein SEQ ID NO:193 is a clone designated herein as "DNA96880-2624".

FIG. 194 shows the amino acid sequence (SEQ ID NO:194) derived from the coding sequence of SEQ ID NO:193 shown in FIG. 193.

FIG. 195 shows a nucleotide sequence (SEQ ID NO:195) of a native sequence PRO4994 cDNA, wherein SEQ ID NO:195 is a clone designated herein as "DNA96986-2660".

FIG. 196 shows the amino acid sequence (SEQ ID NO:196) derived from the coding sequence of SEQ ID NO:195 shown in FIG. 195.

FIG. 197 shows a nucleotide sequence (SEQ ID NO:197) of a native sequence PRO5995 cDNA, wherein SEQ ID NO:197 is a clone designated herein as "DNA96988-2685".

FIG. 198 shows the amino acid sequence (SEQ ID NO:198) derived from the coding sequence of SEQ ID NO:197 shown in FIG. 197.

FIG. 199 shows a nucleotide sequence (SEQ ID NO:199) of a native sequence PRO6094 cDNA, wherein SEQ ID NO:199 is a clone designated herein as "DNA96995-2709".

FIG. 200 shows the amino acid sequence (SEQ ID NO:200) derived from the coding sequence of SEQ ID NO:199 shown in FIG. 199.

FIG. 201 shows a nucleotide sequence (SEQ ID NO:201) of a native sequence PRO4317 cDNA, wherein SEQ ID NO:201 is a clone designated herein as "DNA97004-2562".

FIG. 202 shows the amino acid sequence (SEQ ID NO:202) derived from the coding sequence of SEQ ID NO:201 shown in FIG. 201.

FIG. 203 shows a nucleotide sequence (SEQ ID NO:203) of a native sequence PRO5997 cDNA, wherein SEQ ID NO:203 is a clone designated herein as "DNA97005-2687".

FIG. 204 shows the amino acid sequence (SEQ ID NO:204) derived from the coding sequence of SEQ ID NO:203 shown in FIG. 203.

FIG. 205 shows a nucleotide sequence (SEQ ID NO:205) of a native sequence PRO5005 cDNA, wherein SEQ ID NO:205 is a clone designated herein as "DNA97009-2668".

FIG. 206 shows the amino acid sequence (SEQ ID NO:206) derived from the coding sequence of SEQ ID NO:205 shown in FIG. 205.

FIG. 207 shows a nucleotide sequence (SEQ ID NO:207) of a native sequence PRO5004 cDNA, wherein SEQ ID NO:207 is a clone designated herein as "DNA97013-2667".

FIG. 208 shows the amino acid sequence (SEQ ID NO:208) derived from the coding sequence of SEQ ID NO:207 shown in FIG. 207.

FIG. 209 shows a nucleotide sequence (SEQ ID NO:209) of a native sequence PRO6001 cDNA, wherein SEQ ID NO:209 is a clone designated herein as "DNA98380-2690".

FIG. 210 shows the amino acid sequence (SEQ ID NO:210) derived from the coding sequence of SEQ ID NO:209 shown in FIG. 209.

FIG. 211 shows a nucleotide sequence (SEQ ID NO:211) of a native sequence PRO6013 cDNA, wherein SEQ ID NO:211 is a clone designated herein as "DNA98561-2696".

FIG. 212 shows the amino acid sequence (SEQ ID NO:212) derived from the coding sequence of SEQ ID NO:211 shown in FIG. 211.

FIG. 213 shows a nucleotide sequence (SEQ ID NO:213) of a native sequence PRO4502 cDNA, wherein SEQ ID NO:213 is a clone designated herein as "DNA98575-2644".

FIG. 214 shows the amino acid sequence (SEQ ID NO:214) derived from the coding sequence of SEQ ID NO:213 shown in FIG. 213.

FIG. 215 shows a nucleotide sequence (SEQ ID NO:215) of a native sequence PRO6007 cDNA, wherein SEQ ID NO:215 is a clone designated herein as "DNA98593-2694".

FIG. 216 shows the amino acid sequence (SEQ ID NO:216) derived from the coding sequence of SEQ ID NO:215 shown in FIG. 215.

FIG. 217 shows a nucleotide sequence (SEQ ID NO:217) of a native sequence PRO6028 cDNA, wherein SEQ ID NO:217 is a clone designated herein as "DNA98600-2703".

FIG. 218 shows the amino acid sequence (SEQ ID NO:218) derived from the coding sequence of SEQ ID NO:217 shown in FIG. 217.

FIG. 219 shows a nucleotide sequence (SEQ ID NO:219) of a native sequence PRO100 cDNA, wherein SEQ ID NO:219 is a clone designated herein as "DNA99333".

FIG. 220 shows the amino acid sequence (SEQ ID NO:220) derived from the coding sequence of SEQ ID NO:219 shown in FIG. 219.

FIG. 221 shows a nucleotide sequence (SEQ ID NO:221) of a native sequence PRO4327 cDNA, wherein SEQ ID NO:221 is a clone designated herein as "DNA99391-2572".

FIG. 222 shows the amino acid sequence (SEQ ID NO:222) derived from the coding sequence of SEQ ID NO:221 shown in FIG. 221.

FIG. 223 shows a nucleotide sequence (SEQ ID NO:223) of a native sequence PRO4315 cDNA, wherein SEQ ID NO:223 is a clone designated herein as "DNA99393-2560".

FIG. 224 shows the amino acid sequence (SEQ ID NO:224) derived from the coding sequence of SEQ ID NO:223 shown in FIG. 223.

FIG. 225 shows a nucleotide sequence (SEQ ID NO:225) of a native sequence PRO5993 cDNA, wherein SEQ ID NO:225 is a clone designated herein as "DNA100276-2684".

FIG. 226 shows the amino acid sequence (SEQ ID NO:226) derived from the coding sequence of SEQ ID NO:225 shown in FIG. 225.

FIG. 227 shows a nucleotide sequence (SEQ ID NO:227) of a native sequence PRO4503 cDNA, wherein SEQ ID NO:227 is a clone designated herein as "DNA100312-2645".

FIG. 228 shows the amino acid sequence (SEQ ID NO:228) derived from the coding sequence of SEQ ID NO:227 shown in FIG. 227.

FIG. 229 shows a nucleotide sequence (SEQ ID NO:229) of a native sequence PRO4976 cDNA, wherein SEQ ID NO:229 is a clone designated herein as "DNA100902-2646".

FIG. 230 shows the amino acid sequence (SEQ ID NO:230) derived from the coding sequence of SEQ ID NO:229 shown in FIG. 229.

FIG. 231 shows a nucleotide sequence (SEQ ID NO:231) of a native sequence PRO5798 cDNA, wherein SEQ ID NO:231 is a clone designated herein as "DNA102899-2679".

FIG. 232 shows the amino acid sequence (SEQ ID NO:232) derived from the coding sequence of SEQ ID NO:231 shown in FIG. 231.

FIG. 233 shows a nucleotide sequence (SEQ ID NO:233) of a native sequence PRO6242 cDNA, wherein SEQ ID NO:233 is a clone designated herein as "DNA104875-2720".

FIG. 234 shows the amino acid sequence (SEQ ID NO:234) derived from the coding sequence of SEQ ID NO:233 shown in FIG. 233.

FIG. 235 shows a nucleotide sequence (SEQ ID NO:235) of a native sequence PRO6095 cDNA, wherein SEQ ID NO:235 is a clone designated herein as "DNA105680-2710".

FIG. 236 shows the amino acid sequence (SEQ ID NO:236) derived from the coding sequence of SEQ ID NO:235 shown in FIG. 235.

FIG. 237 shows a nucleotide sequence (SEQ ID NO:237) of a native sequence PRO6093 cDNA, wherein SEQ ID NO:237 is a clone designated herein as "DNA105779-2708".

FIG. 238 shows the amino acid sequence (SEQ ID NO:238) derived from the coding sequence of SEQ ID NO:237 shown in FIG. 237.

FIG. 239 shows a nucleotide sequence (SEQ ID NO:239) of a native sequence PRO6012 cDNA, wherein SEQ ID NO:239 is a clone designated herein as "DNA105794-2695".

FIG. 240 shows the amino acid sequence (SEQ ID NO:240) derived from the coding sequence of SEQ ID NO:239 shown in FIG. 239.

FIG. 241 shows a nucleotide sequence (SEQ ID NO:241) of a native sequence PRO6027 cDNA, wherein SEQ ID NO:241 is a clone designated herein as "DNA105838-2702".

FIG. 242 shows the amino acid sequence (SEQ ID NO:242) derived from the coding sequence of SEQ ID NO:241 shown in FIG. 241.

FIG. 243 shows a nucleotide sequence (SEQ ID NO:243) of a native sequence PRO6181 cDNA, wherein SEQ ID NO:243 is a clone designated herein as "DNA107698-2715".

FIG. 244 shows the amino acid sequence (SEQ ID NO:244) derived from the coding sequence of SEQ ID NO:243 shown in FIG. 243.

FIG. 245 shows a nucleotide sequence (SEQ ID NO:245) of a native sequence PRO6097 cDNA, wherein SEQ ID NO:245 is a clone designated herein as "DNA107701-2711".

FIG. 246 shows the amino acid sequence (SEQ ID NO:246) derived from the coding sequence of SEQ ID NO:245 shown in FIG. 245.

FIG. 247 shows a nucleotide sequence (SEQ ID NO:247) of a native sequence PRO6090 cDNA, wherein SEQ ID NO:247 is a clone designated herein as "DNA107781-2707".

FIG. 248 shows the amino acid sequence (SEQ ID NO:248) derived from the coding sequence of SEQ ID NO:247 shown in FIG. 247.

FIG. 249 shows a nucleotide sequence (SEQ ID NO:249) of a native sequence PRO7171 cDNA, wherein SEQ ID NO:249 is a clone designated herein as "DNA108670-2744".

FIG. 250 shows the amino acid sequence (SEQ ID NO:250) derived from the coding sequence of SEQ ID NO:249 shown in FIG. 249.

FIG. 251 shows a nucleotide sequence (SEQ ID NO:251) of a native sequence PRO6258 cDNA, wherein SEQ ID NO:251 is a clone designated herein as "DNA108688-2725".

FIG. 252 shows the amino acid sequence (SEQ ID NO:252) derived from the coding sequence of SEQ ID NO:251 shown in FIG. 251.

FIG. 253 shows a nucleotide sequence (SEQ ID NO:253) of a native sequence PRO9820 cDNA, wherein SEQ ID NO:253 is a clone designated herein as "DNA108769-2765".

FIG. 254 shows the amino acid sequence (SEQ ID NO:254) derived from the coding sequence of SEQ ID NO:253 shown in FIG. 253.

FIG. 255 shows a nucleotide sequence (SEQ ID NO:255) of a native sequence PRO6243 cDNA, wherein SEQ ID NO:255 is a clone designated herein as "DNA108935-2721".

FIG. 256 shows the amino acid sequence (SEQ ID NO:256) derived from the coding sequence of SEQ ID NO:255 shown in FIG. 255.

FIG. 257 shows a nucleotide sequence (SEQ ID NO:257) of a native sequence PRO6182 cDNA, wherein SEQ ID NO:257 is a clone designated herein as "DNA110700-2716".

FIG. 258 shows the amino acid sequence (SEQ ID NO:258) derived from the coding sequence of SEQ ID NO:257 shown in FIG. 257.

FIG. 259 shows a nucleotide sequence (SEQ ID NO:259) of a native sequence PRO6079 cDNA, wherein SEQ ID NO:259 is a clone designated herein as "DNA111750-2706".

FIG. 260 shows the amino acid sequence (SEQ ID NO:260) derived from the coding sequence of SEQ ID NO:259 shown in FIG. 259.

FIG. 261 shows a nucleotide sequence (SEQ ID NO:261) of a native sequence PRO7434 cDNA, wherein SEQ ID NO:261 is a clone designated herein as "DNA123430-2755".

FIG. 262 shows the amino acid sequence (SEQ ID NO:262) derived from the coding sequence of SEQ ID NO:261 shown in FIG. 261.

FIG. 263 shows a nucleotide sequence (SEQ ID NO:263) of a native sequence PRO9865 cDNA, wherein SEQ ID NO:263 is a clone designated herein as "DNA125154-2785".

FIG. 264 shows the amino acid sequence (SEQ ID NO:264) derived from the coding sequence of SEQ ID NO:263 shown in FIG. 263.

FIG. 265 shows a nucleotide sequence (SEQ ID NO:265) of a native sequence PRO9828 cDNA, wherein SEQ ID NO:265 is a clone designated herein as "DNA142238-2768".

FIG. 266 shows the amino acid sequence (SEQ ID NO:266) derived from the coding sequence of SEQ ID NO:265 shown in FIG. 265.

FIG. 267 shows a nucleotide sequence (SEQ ID NO:267) of a native sequence PRO196 cDNA, wherein SEQ ID NO:267 is a clone designated herein as "DNA22779-1130".

FIG. 268 shows the amino acid sequence (SEQ ID NO:268) derived from the coding sequence of SEQ ID NO:267 shown in FIG. 267.

FIG. 269 shows a nucleotide sequence (SEQ ID NO:269) of a native sequence PRO197 cDNA, wherein SEQ ID NO:269 is a clone designated herein as "DNA22780-1078".

FIG. 270 shows the amino acid sequence (SEQ ID NO:270) derived from the coding sequence of SEQ ID NO:269 shown in FIG. 269.

FIG. 271 shows a nucleotide sequence (SEQ ID NO:271) of a native sequence PRO195 cDNA, wherein SEQ ID NO:271 is a clone designated herein as "DNA26847-1395".

FIG. 272 shows the amino acid sequence (SEQ ID NO:272) derived from the coding sequence of SEQ ID NO:271 shown in FIG. 271.

FIG. 273 shows a nucleotide sequence (SEQ ID NO:273) of a native sequence PRO187 cDNA, wherein SEQ ID NO:273 is a clone designated herein as "DNA27864-1155".

FIG. 274 shows the amino acid sequence (SEQ ID NO:274) derived from the coding sequence of SEQ ID NO:273 shown in FIG. 273.

FIG. 275 shows a nucleotide sequence (SEQ ID NO:275) of a native sequence PRO182 cDNA, wherein SEQ ID NO:275 is a clone designated herein as "DNA27865-1091".

FIG. 276 shows the amino acid sequence (SEQ ID NO:276) derived from the coding sequence of SEQ ID NO:275 shown in FIG. 275.

FIG. 277 shows a nucleotide sequence (SEQ ID NO:277) of a native sequence PRO188 cDNA, wherein SEQ ID NO:277 is a clone designated herein as "DNA28497-1130".

FIG. 278 shows the amino acid sequence (SEQ ID NO:278) derived from the coding sequence of SEQ ID NO:277 shown in FIG. 277.

FIG. 279 shows a nucleotide sequence (SEQ ID NO:279) of a native sequence PRO183 cDNA, wherein SEQ ID NO:279 is a clone designated herein as "DNA28498".

FIG. 280 shows the amino acid sequence (SEQ ID NO:280) derived from the coding sequence of SEQ ID NO:279 shown in FIG. 279.

FIG. 281 shows a nucleotide sequence (SEQ ID NO:281) of a native sequence PRO184 cDNA, wherein SEQ ID NO:281 is a clone designated herein as "DNA28500".

FIG. 282 shows the amino acid sequence (SEQ ID NO:282) derived from the coding sequence of SEQ ID NO:281 shown in FIG. 281.

FIG. 283 shows a nucleotide sequence (SEQ ID NO:283) of a native sequence PRO185 cDNA, wherein SEQ ID NO:283 is a clone designated herein as "DNA28503".

FIG. 284 shows the amino acid sequence (SEQ ID NO:284) derived from the coding sequence of SEQ ID NO:283 shown in FIG. 283.

FIG. 285 shows a nucleotide sequence (SEQ ID NO:285) of a native sequence PRO200 cDNA, wherein SEQ ID NO:285 is a clone designated herein as "DNA29101-1122".

FIG. 286 shows the amino acid sequence (SEQ ID NO:286) derived from the coding sequence of SEQ ID NO:285 shown in FIG. 285.

FIG. 287 shows a nucleotide sequence (SEQ ID NO:287) of a native sequence PRO202 cDNA, wherein SEQ ID NO:287 is a clone designated herein as "DNA30869".

FIG. 288 shows the amino acid sequence (SEQ ID NO:288) derived from the coding sequence of SEQ ID NO:287 shown in FIG. 287.

FIG. 289 shows a nucleotide sequence (SEQ ID NO:289) of a native sequence PRO214 cDNA, wherein SEQ ID NO:289 is a clone designated herein as "DNA32286-1191".

FIG. 290 shows the amino acid sequence (SEQ ID NO:290) derived from the coding sequence of SEQ ID NO:289 shown in FIG. 289.

FIG. 291 shows a nucleotide sequence (SEQ ID NO:291) of a native sequence PRO215 cDNA, wherein SEQ ID NO:291 is a clone designated herein as "DNA32288-1132".

FIG. 292 shows the amino acid sequence (SEQ ID NO:292) derived from the coding sequence of SEQ ID NO:291 shown in FIG. 291.

FIG. 293 shows a nucleotide sequence (SEQ ID NO:293) of a native sequence PRO219 cDNA, wherein SEQ ID NO:293 is a clone designated herein as "DNA32290-1164".

FIG. 294 shows the amino acid sequence (SEQ ID NO:294) derived from the coding sequence of SEQ ID NO:293 shown in FIG. 293.

FIG. 295 shows a nucleotide sequence (SEQ ID NO:295) of a native sequence PRO211 cDNA, wherein SEQ ID NO:295 is a clone designated herein as "DNA32292-1131".

FIG. 296 shows the amino acid sequence (SEQ ID NO:296) derived from the coding sequence of SEQ ID NO:295 shown in FIG. 295.

FIG. 297 shows a nucleotide sequence (SEQ ID NO:297) of a native sequence PRO220 cDNA, wherein SEQ ID NO:297 is a clone designated herein as "DNA32298-1132".

FIG. 298 shows the amino acid sequence (SEQ ID NO:298) derived from the coding sequence of SEQ ID NO:297 shown in FIG. 297.

FIG. 299 shows a nucleotide sequence (SEQ ID NO:299) of a native sequence PRO366 cDNA, wherein SEQ ID NO:299 is a clone designated herein as "DNA33085-1110".

FIG. 300 shows the amino acid sequence (SEQ ID NO:300) derived from the coding sequence of SEQ ID NO:299 shown in FIG. 299.

FIG. 301 shows a nucleotide sequence (SEQ ID NO:301) of a native sequence PRO216 cDNA, wherein SEQ ID NO:301 is a clone designated herein as "DNA33087-1158".

FIG. 302 shows the amino acid sequence (SEQ ID NO:302) derived from the coding sequence of SEQ ID NO:301 shown in FIG. 301.

FIG. 303 shows a nucleotide sequence (SEQ ID NO:303) of a native sequence PRO221 cDNA, wherein SEQ ID NO:303 is a clone designated herein as "DNA33089-1132".

FIG. 304 shows the amino acid sequence (SEQ ID NO:304) derived from the coding sequence of SEQ ID NO:303 shown in FIG. 303.

FIG. 305 shows a nucleotide sequence (SEQ ID NO:305) of a native sequence PRO228 cDNA, wherein SEQ ID NO:305 is a clone designated herein as "DNA33092-1202".

FIG. 306 shows the amino acid sequence (SEQ ID NO:306) derived from the coding sequence of SEQ ID NO:305 shown in FIG. 305.

FIG. 307 shows a nucleotide sequence (SEQ ID NO:307) of a native sequence PRO217 EDNA, wherein SEQ ID NO:307 is a clone designated herein as "DNA33094-1131".

FIG. 308 shows the amino acid sequence (SEQ ID NO:308) derived from the coding sequence of SEQ ID NO:307 shown in FIG. 307.

FIG. 309 shows a nucleotide sequence (SEQ ID NO:309) of a native sequence PRO222 cDNA, wherein SEQ ID NO:309 is a clone designated herein as "DNA33 107-1135".

FIG. 310 shows the amino acid sequence (SEQ ID NO:310) derived from the coding sequence of SEQ ID NO:309 shown in FIG. 309.

FIG. 311 shows a nucleotide sequence (SEQ ID NO:311) of a native sequence PRO224 cDNA, wherein SEQ ID NO:311 is a clone designated herein as "DNA33221-1133".

FIG. 312 shows the amino acid sequence (SEQ ID NO:312) derived from the coding sequence of SEQ ID NO:311 shown in FIG. 311.

FIG. 313 shows a nucleotide sequence (SEQ ID NO:313) of a native sequence PRO230 cDNA, wherein SEQ ID NO:313 is a clone designated herein as "DNA33223-1136".

FIG. 314 shows the amino acid sequence (SEQ ID NO:314) derived from the coding sequence of SEQ ID NO:313 shown in FIG. 313.

FIG. 315 shows a nucleotide sequence (SEQ ID NO:315) of a native sequence PRO198 cDNA, wherein SEQ ID NO:315 is a clone designated herein as "DNA33457-1078".

FIG. 316 shows the amino acid sequence (SEQ ID NO:316) derived from the coding sequence of SEQ ID NO:315 shown in FIG. 315.

FIG. 317 shows a nucleotide sequence (SEQ ID NO:317) of a native sequence PRO226 cDNA, wherein SEQ ID NO:317 is a clone designated herein as "DNA33460-1166".

FIG. 318 shows the amino acid sequence (SEQ ID NO:318) derived from the coding sequence of SEQ ID NO:317 shown in FIG. 317.

FIG. 319 shows a nucleotide sequence (SEQ ID NO:319) of a native sequence PRO261 cDNA, wherein SEQ ID NO:319 is a clone designated herein as "DNA33473-1176".

FIG. 320 shows the amino acid sequence (SEQ ID NO:320) derived from the coding sequence of SEQ ID NO:319 shown in FIG. 319.

FIG. 321 shows a nucleotide sequence (SEQ ID NO:321) of a native sequence PRO242 cDNA, wherein SEQ ID NO:321 is a clone designated herein as "DNA33785-1143".

FIG. 322 shows the amino acid sequence (SEQ ID NO:322) derived from the coding sequence of SEQ ID NO:321 shown in FIG. 321.

FIG. 323 shows a nucleotide sequence (SEQ ID NO:323) of a native sequence PRO227 cDNA, wherein SEQ ID NO:323 is a clone designated herein as "DNA33786-1132".

FIG. 324 shows the amino acid sequence (SEQ ID NO:324) derived from the coding sequence of SEQ ID NO:323 shown in FIG. 323.

FIG. 325 shows a nucleotide sequence (SEQ ID NO:325) of a native sequence PRO237 cDNA, wherein SEQ ID NO:325 is a clone designated herein as "DNA34353-1428".

FIG. 326 shows the amino acid sequence (SEQ ID NO:326) derived from the coding sequence of SEQ ID NO:325 shown in FIG. 325.

FIG. 327 shows a nucleotide sequence (SEQ ID NO:327) of a native sequence PRO241 cDNA, wherein SEQ ID NO:327 is a clone designated herein as "DNA34392-1170".

FIG. 328 shows the amino acid sequence (SEQ ID NO:328) derived from the coding sequence of SEQ ID NO:327 shown in FIG. 327.

FIG. 329 shows a nucleotide sequence (SEQ ID NO:329) of a native sequence PRO231 cDNA, wherein SEQ ID NO:329 is a clone designated herein as "DNA34434-1139".

FIG. 330 shows the amino acid sequence (SEQ ID NO:330) derived from the coding sequence of SEQ ID NO:329 shown in FIG. 329.

FIG. 331 shows a nucleotide sequence (SEQ ID NO:331) of a native sequence PRO235 cDNA, wherein SEQ ID NO:331 is a clone designated herein as "DNA35558-1167".

FIG. 332 shows the amino acid sequence (SEQ ID NO:332) derived from the coding sequence of SEQ ID NO:331 shown in FIG. 331.

FIG. 333 shows a nucleotide sequence (SEQ ID NO:333) of a native sequence PRO323 cDNA, wherein SEQ ID NO:333 is a clone designated herein as "DNA35595-1228".

FIG. 334 shows the amino acid sequence (SEQ ID NO:334) derived from the coding sequence of SEQ ID NO:333 shown in FIG. 333.

FIG. 335 shows a nucleotide sequence (SEQ ID NO:335) of a native sequence PRO245 cDNA, wherein SEQ ID NO:335 is a clone designated herein as "DNA35638-1216".

FIG. 336 shows the amino acid sequence (SEQ ID NO:336) derived from the coding sequence of SEQ ID NO:335 shown in FIG. 335.

FIG. 337 shows a nucleotide sequence (SEQ ID NO:337) of a native sequence PRO246 cDNA, wherein SEQ ID NO:337 is a clone designated herein as "DNA35639-1172".

FIG. 338 shows the amino acid sequence (SEQ ID NO:338) derived from the coding sequence of SEQ ID NO:337 shown in FIG. 337.

FIG. 339 shows a nucleotide sequence (SEQ ID NO:339) of a native sequence PRO288 cDNA, wherein SEQ ID NO:339 is a clone designated herein as "DNA35663-1129".

FIG. 340 shows the amino acid sequence (SEQ ID NO:340) derived from the coding sequence of SEQ ID NO:339 shown in FIG. 339.

FIG. 341 shows a nucleotide sequence (SEQ ID NO:341) of a native sequence PRO248 cDNA, wherein SEQ ID NO:341 is a clone designated herein as "DNA35674-1142".

FIG. 342 shows the amino acid sequence (SEQ ID NO:342) derived from the coding sequence of SEQ ID NO:341 shown in FIG. 341.

FIG. 343 shows a nucleotide sequence (SEQ ID NO:343) of a native sequence PRO257 cDNA, wherein SEQ ID NO:343 is a clone designated herein as "DNA35841-1173".

FIG. 344 shows the amino acid sequence (SEQ ID NO:344) derived from the coding sequence of SEQ ID NO:343 shown in FIG. 343.

FIG. 345 shows a nucleotide sequence (SEQ ID NO:345) of a native sequence PRO172 cDNA, wherein SEQ ID NO:345 is a clone designated herein as "DNA35916-1161".

FIG. 346 shows the amino acid sequence (SEQ ID NO:346) derived from the coding sequence of SEQ ID NO:345 shown in FIG. 345.

FIG. 347 shows a nucleotide sequence (SEQ ID NO:347) of a native sequence PRO258 cDNA, wherein SEQ ID NO:347 is a clone designated herein as "DNA35918-1174".

FIG. 348 shows the amino acid sequence (SEQ ID NO:348) derived from the coding sequence of SEQ ID NO:347 shown in FIG. 347.

FIG. 349 shows a nucleotide sequence (SEQ ID NO:349) of a native sequence PRO265 cDNA, wherein SEQ ID NO:349 is a clone designated herein as "DNA36350-1158".

FIG. 350 shows the amino acid sequence (SEQ ID NO:350) derived from the coding sequence of SEQ ID NO:349 shown in FIG. 349.

FIG. 351 shows a nucleotide sequence (SEQ ID NO:351) of a native sequence PRO326 cDNA, wherein SEQ ID NO:351 is a clone designated herein as "DNA37140-1234".

FIG. 352 shows the amino acid sequence (SEQ ID NO:352) derived from the coding sequence of SEQ ID NO:351 shown in FIG. 351.

FIG. 353 shows a nucleotide sequence (SEQ ID NO:353) of a native sequence PRO266 cDNA, wherein SEQ ID NO:353 is a clone designated herein as "DNA37150-1178".

FIG. 354 shows the amino acid sequence (SEQ ID NO:354) derived from the coding sequence of SEQ ID NO:353 shown in FIG. 353.

FIG. 355 shows a nucleotide sequence (SEQ ID NO:355) of a native sequence PRO269 cDNA, wherein SEQ ID NO:355 is a clone designated herein as "DNA38260-1180".

FIG. 356 shows the amino acid sequence (SEQ ID NO:356) derived from the coding sequence of SEQ ID NO:355 shown in FIG. 355.

FIG. 357 shows a nucleotide sequence (SEQ ID NO:357) of a native sequence PRO285 cDNA, wherein SEQ ID NO:357 is a clone designated herein as "DNA40021-1154".

FIG. 358 shows the amino acid sequence (SEQ ID NO:358) derived from the coding sequence of SEQ ID NO:357 shown in FIG. 357.

FIG. 359 shows a nucleotide sequence (SEQ ID NO:359) of a native sequence PRO328 cDNA, wherein SEQ ID NO:359 is a clone designated herein as "DNA40587-1231".

FIG. 360 shows the amino acid sequence (SEQ ID NO:360) derived from the coding sequence of SEQ ID NO:359 shown in FIG. 359.

FIG. 361 shows a nucleotide sequence (SEQ ID NO:361) of a native sequence PRO344 cDNA, wherein SEQ ID NO:361 is a clone designated herein as "DNA40592-1242".

FIG. 362 shows the amino acid sequence (SEQ ID NO:362) derived from the coding sequence of SEQ ID NO:361 shown in FIG. 361. FIG. 363 shows a nucleotide sequence (SEQ ID NO:363) of a native sequence PRO272 cDNA, wherein SEQ ID NO:363 is a clone designated herein as "DNA40620-1183".

FIG. 364 shows the amino acid sequence (SEQ ID NO:364) derived from the coding sequence of SEQ ID NO:363 shown in FIG. 363.

FIG. 365 shows a nucleotide sequence (SEQ ID NO:365) of a native sequence PRO301 cDNA, wherein SEQ ID NO:365 is a clone designated herein as "DNA40628-1216".

FIG. 366 shows the amino acid sequence (SEQ ID NO:366) derived from the coding sequence of SEQ ID NO:365 shown in FIG. 365.

FIG. 367 shows a nucleotide sequence (SEQ ID NO:367) of a native sequence PRO331 cDNA, wherein SEQ ID NO:367 is a clone designated herein as "DNA40981-1234".

FIG. 368 shows the amino acid sequence (SEQ ID NO:368) derived from the coding sequence of SEQ ID NO:367 shown in FIG. 367.

FIG. 369 shows a nucleotide sequence (SEQ ID NO:369) of a native sequence PRO332 cDNA, wherein SEQ ID NO:369 is a clone designated herein as "DNA40982-1235".

FIG. 370 shows the amino acid sequence (SEQ ID NO:370) derived from the coding sequence of SEQ ID NO:369 shown in FIG. 369.

FIG. 371 shows a nucleotide sequence (SEQ ID NO:371) of a native sequence PRO353 cDNA, wherein SEQ ID NO:371 is a clone designated herein as "DNA41234-1242".

FIG. 372 shows the amino acid sequence (SEQ ID NO:372) derived from the coding sequence of SEQ ID NO:371 shown in FIG. 371.

FIG. 373 shows a nucleotide sequence (SEQ ID NO:373) of a native sequence PRO310 cDNA, wherein SEQ ID NO:373 is a clone designated herein as "DNA43046-1225".

FIG. 374 shows the amino acid sequence (SEQ ID NO:374) derived from the coding sequence of SEQ ID NO:373 shown in FIG. 373.

FIG. 375 shows a nucleotide sequence (SEQ ID NO:375) of a native sequence PRO337 cDNA, wherein SEQ ID NO:375 is a clone designated herein as "DNA43316-1237".

FIG. 376 shows the amino acid sequence (SEQ ID NO:376) derived from the coding sequence of SEQ ID NO:375 shown in FIG. 375.

FIG. 377 shows a nucleotide sequence (SEQ ID NO:377) of a native sequence PRO346 cDNA, wherein SEQ ID NO:377 is a clone designated herein as "DNA44167-1243".

FIG. 378 shows the amino acid sequence (SEQ ID NO:378) derived from the coding sequence of SEQ ID NO:377 shown in FIG. 377.

FIG. 379 shows a nucleotide sequence (SEQ ID NO:379) of a native sequence PRO350 cDNA, wherein SEQ ID NO:379 is a clone designated herein as "DNA44175-1314".

FIG. 380 shows the amino acid sequence (SEQ ID NO:380) derived from the coding sequence of SEQ ID NO:379 shown in FIG. 379.

FIG. 381 shows a nucleotide sequence (SEQ ID NO:381) of a native sequence PRO526 cDNA, wherein SEQ ID NO:381 is a clone designated herein as "DNA44184-1319".

FIG. 382 shows the amino acid sequence (SEQ ID NO:382) derived from the coding sequence of SEQ ID NO:381 shown in FIG. 381.

FIG. 383 shows a nucleotide sequence (SEQ ID NO:383) of a native sequence PRO381 cDNA, wherein SEQ ID NO:383 is a clone designated herein as "DNA44194-1317".

FIG. 384 shows the amino acid sequence (SEQ ID NO:384) derived from the coding sequence of SEQ ID NO:383 shown in FIG. 383.

FIG. 385 shows a nucleotide sequence (SEQ ID NO:385) of a native sequence PRO846 cDNA, wherein SEQ ID NO:385 is a clone designated herein as "DNA44196-1353".

FIG. 386 shows the amino acid sequence (SEQ ID NO:386) derived from the coding sequence of SEQ ID NO:385 shown in FIG. 385.

FIG. 387 shows a nucleotide sequence (SEQ ID NO:387) of a native sequence PRO363 cDNA, wherein SEQ ID NO:387 is a clone designated herein as "DNA45419-1252".

FIG. 388 shows the amino acid sequence (SEQ ID NO:388) derived from the coding sequence of SEQ ID NO:387 shown in FIG. 387.

FIG. 389 shows a nucleotide sequence (SEQ ID NO:389) of a native sequence PRO365 cDNA, wherein SEQ ID NO:389 is a clone designated herein as "DNA46777-1253".

FIG. 390 shows the amino acid sequence (SEQ ID NO:390) derived from the coding sequence of SEQ ID NO:389 shown in FIG. 389.

FIG. 391 shows a nucleotide sequence (SEQ ID NO:391) of a native sequence PRO1310 cDNA, wherein SEQ ID NO:391 is a clone designated herein as "DNA47394-1572".

FIG. 392 shows the amino acid sequence (SEQ ID NO:392) derived from the coding sequence of SEQ ID NO:391 shown in FIG. 391.

FIG. 393 shows a nucleotide sequence (SEQ ID NO:393) of a native sequence PRO731 cDNA, wherein SEQ ID NO:393 is a clone designated herein as "DNA48331-1329".

FIG. 394 shows the amino acid sequence (SEQ ID NO:394) derived from the coding sequence of SEQ ID NO:393 shown in FIG. 393.

FIG. 395 shows a nucleotide sequence (SEQ ID NO:395) of a native sequence PRO322 cDNA, wherein SEQ ID NO:395 is a clone designated herein as "DNA48336-1309".

FIG. 396 shows the amino acid sequence (SEQ ID NO:396) derived from the coding sequence of SEQ ID NO:395 shown in FIG. 395.

FIG. 397 shows a nucleotide sequence (SEQ ID NO:397) of a native sequence PRO536 cDNA, wherein SEQ ID NO:397 is a clone designated herein as "DNA49142-1430".

FIG. 398 shows the amino acid sequence (SEQ ID NO:398) derived from the coding sequence of SEQ ID NO:397 shown in FIG. 397.

FIG. 399 shows a nucleotide sequence (SEQ ID NO:399) of a native sequence PRO719 cDNA, wherein SEQ ID NO:399 is a clone designated herein as "DNA49646-1327".

FIG. 400 shows the amino acid sequence (SEQ ID NO:400) derived from the coding sequence of SEQ ID NO:399 shown in FIG. 399.

FIG. 401 shows a nucleotide sequence (SEQ ID NO:401) of a native sequence PRO619 cDNA, wherein SEQ ID NO:401 is a clone designated herein as "DNA49821-1562".

FIG. 402 shows the amino acid sequence (SEQ ID NO:402) derived from the coding sequence of SEQ ID NO:401 shown in FIG. 401.

FIG. 403 shows a nucleotide sequence (SEQ ID NO:403) of a native sequence PRO771 cDNA, wherein SEQ ID NO:403 is a clone designated herein as "DNA49829-1346".

FIG. 404 shows the amino acid sequence (SEQ ID NO:404) derived from the coding sequence of SEQ ID NO:403 shown in FIG. 403.

FIG. 405 shows a nucleotide sequence (SEQ ID NO:405) of a native sequence PRO1083 cDNA, wherein SEQ ID NO:405 is a clone designated herein as "DNA50921-1458".

FIG. 406 shows the amino acid sequence (SEQ ID NO:406) derived from the coding sequence of SEQ ID NO:405 shown in FIG. 405.

FIG. 407 shows a nucleotide sequence (SEQ ID NO:407) of a native sequence PRO862 cDNA, wherein SEQ ID NO:407 is a clone designated herein as "DNA52187-1354".

FIG. 408 shows the amino acid sequence (SEQ ID NO:408) derived from the coding sequence of SEQ ID NO:407 shown in FIG. 407.

FIG. 409 shows a nucleotide sequence (SEQ ID NO:409) of a native sequence PRO733 cDNA, wherein SEQ ID NO:409 is a clone designated herein as "DNA52196-1348".

FIG. 410 shows the amino acid sequence (SEQ ID NO:410) derived from the coding sequence of SEQ ID NO:409 shown in FIG. 409.

FIG. 411 shows a nucleotide sequence (SEQ ID NO:411) of a native sequence PRO1188 cDNA, wherein SEQ ID NO:411 is a clone designated herein as "DNA52598-1518".

FIG. 412 shows the amino acid sequence (SEQ ID NO:412) derived from the coding sequence of SEQ ID NO:411 shown in FIG. 411.

FIG. 413 shows a nucleotide sequence (SEQ ID NO:413) of a native sequence PRO770 cDNA, wherein SEQ ID NO:413 is a clone designated herein as "DNA54228-1366".

FIG. 414 shows the amino acid sequence (SEQ ID NO:414) derived from the coding sequence of SEQ ID NO:413 shown in FIG. 413.

FIG. 415 shows a nucleotide sequence (SEQ ID NO:415) of a native sequence PRO1080 cDNA, wherein SEQ ID NO:415 is a clone designated herein as "DNA56047-1456".

FIG. 416 shows the amino acid sequence (SEQ ID NO:416) derived from the coding sequence of SEQ ID NO:415 shown in FIG. 415.

FIG. 417 shows a nucleotide sequence (SEQ ID NO:417) of a native sequence PRO1017 cDNA, wherein SEQ ID NO:417 is a clone designated herein as "DNA56112-1379".

FIG. 418 shows the amino acid sequence (SEQ ID NO:418) derived from the coding sequence of SEQ ID NO:417 shown in FIG. 417.

FIG. 419 shows a nucleotide sequence (SEQ ID NO:419) of a native sequence PRO1016 cDNA, wherein SEQ ID NO:419 is a clone designated herein as "DNA56113-1378".

FIG. 420 shows the amino acid sequence (SEQ ID NO:420) derived from the coding sequence of SEQ ID NO:419 shown in FIG. 419.

FIG. 421 shows a nucleotide sequence (SEQ ID NO:421) of a native sequence PRO792 cDNA, wherein SEQ ID NO:421 is a clone designated herein as "DNA56352-1358".

FIG. 422 shows the amino acid sequence (SEQ ID NO:422) derived from the coding sequence of SEQ ID NO:421 shown in FIG. 421.

FIG. 423 shows a nucleotide sequence (SEQ ID NO:423) of a native sequence PRO938 cDNA, wherein SEQ ID NO:423 is a clone designated herein as "DNA56433-1406".

FIG. 424 shows the amino acid sequence (SEQ ID NO:424) derived from the coding sequence of SEQ ID NO:423 shown in FIG. 423.

FIG. 425 shows a nucleotide sequence (SEQ ID NO:425) of a native sequence PRO1012 cDNA, wherein SEQ ID NO:425 is a clone designated herein as "DNA56439-1376".

FIG. 426 shows the amino acid sequence (SEQ ID NO:426) derived from the coding sequence of SEQ ID NO:425 shown in FIG. 425.

FIG. 427 shows a nucleotide sequence (SEQ ID NO:427) of a native sequence PRO1008 cDNA, wherein SEQ ID NO:427 is a clone designated herein as "DNA57530-1375".

FIG. 428 shows the amino acid sequence (SEQ ID NO:428) derived from the coding sequence of SEQ ID NO:427 shown in FIG. 427.

FIG. 429 shows a nucleotide sequence (SEQ ID NO:429) of a native sequence PRO1075 cDNA, wherein SEQ ID NO:429 is a clone designated herein as "DNA57689-1385".

FIG. 430 shows the amino acid sequence (SEQ ID NO:430) derived from the coding sequence of SEQ ID NO:429 shown in FIG. 429.

FIG. 431 shows a nucleotide sequence (SEQ ID NO:431) of a native sequence PRO1007 cDNA, wherein SEQ ID NO:431 is a clone designated herein as "DNA57690-1374".

FIG. 432 shows the amino acid sequence (SEQ ID NO:432) derived from the coding sequence of SEQ ID NO:431 shown in FIG. 431.

FIG. 433 shows a nucleotide sequence (SEQ ID NO:433) of a native sequence PRO1056 cDNA, wherein SEQ ID NO:433 is a clone designated herein as "DNA57693-1424".

FIG. 434 shows the amino acid sequence (SEQ ID NO:434) derived from the coding sequence of SEQ ID NO:433 shown in FIG. 433.

FIG. 435 shows a nucleotide sequence (SEQ ID NO:435) of a native sequence PRO791 cDNA, wherein SEQ ID NO:435 is a clone designated herein as "DNA57838-1337".

FIG. 436 shows the amino acid sequence (SEQ ID NO:436) derived from the coding sequence of SEQ ID NO:435 shown in FIG. 435.

FIG. 437 shows a nucleotide sequence (SEQ ID NO:437) of a native sequence PRO1111 cDNA, wherein SEQ ID NO:437 is a clone designated herein as "DNA58721-1475".

FIG. 438 shows the amino acid sequence (SEQ ID NO:438) derived from the coding sequence of SEQ ID NO:437 shown in FIG. 437.

FIG. 439 shows a nucleotide sequence (SEQ ID NO:439) of a native sequence PRO812 cDNA, wherein SEQ ID NO:439 is a clone designated herein as "DNA59205-1421".

FIG. 440 shows the amino acid sequence (SEQ ID NO:440) derived from the coding sequence of SEQ ID NO:439 shown in FIG. 439.

FIG. 441 shows a nucleotide sequence (SEQ ID NO:441) of a native sequence PRO1066 cDNA, wherein SEQ ID NO:441 is a clone designated herein as "DNA59215-1425".

FIG. 442 shows the amino acid sequence (SEQ ID NO:442) derived from the coding sequence of SEQ ID NO:441 shown in FIG. 441.

FIG. 443 shows a nucleotide sequence (SEQ ID NO:443) of a native sequence PRO1185 cDNA, wherein SEQ ID NO:443 is a clone designated herein as "DNA59220-1514".

FIG. 444 shows the amino acid sequence (SEQ ID NO:444) derived from the coding sequence of SEQ ID NO:443 shown in FIG. 443.

FIG. 445 shows a nucleotide sequence (SEQ ID NO:445) of a native sequence PRO1031 cDNA, wherein SEQ ID NO:445 is a clone designated herein as "DNA59294-1381".

FIG. 446 shows the amino acid sequence (SEQ ID NO:446) derived from the coding sequence of SEQ ID NO:445 shown in FIG. 445.

FIG. 447 shows a nucleotide sequence (SEQ ID NO:447) of a native sequence PRO1360 cDNA, wherein SEQ ID NO:447 is a clone designated herein as "DNA59488-1603".

FIG. 448 shows the amino acid sequence (SEQ ID NO:448) derived from the coding sequence of SEQ ID NO:447 shown in FIG. 447.

FIG. 449 shows a nucleotide sequence (SEQ ID NO:449) of a native sequence PRO1309 cDNA, wherein SEQ ID NO:449 is a clone designated herein as "DNA59588-1571".

FIG. 450 shows the amino acid sequence (SEQ ID NO:450) derived from the coding sequence of SEQ ID NO:449 shown in FIG. 449.

FIG. 451 shows a nucleotide sequence (SEQ ID NO:451) of a native sequence PRO1107 cDNA, wherein SEQ ID NO:451 is a clone designated herein as "DNA59606-1471".

FIG. 452 shows the amino acid sequence (SEQ ID NO:452) derived from the coding sequence of SEQ ID NO:451 shown in FIG. 451.

FIG. 453 shows a nucleotide sequence (SEQ ID NO:453) of a native sequence PRO836 cDNA, wherein SEQ ID NO:453 is a clone designated herein as "DNA59620-1463".

FIG. 454 shows the amino acid sequence (SEQ ID NO:454) derived from the coding sequence of SEQ ID NO:453 shown in FIG. 453.

FIG. 455 shows a nucleotide sequence (SEQ ID NO:455) of a native sequence PRO1132 cDNA, wherein SEQ ID NO:455 is a clone designated herein as "DNA59767-1489".

FIG. 456 shows the amino acid sequence (SEQ ID NO:456) derived from the coding sequence of SEQ ID NO:455 shown in FIG. 455.

FIG. 457 shows a nucleotide sequence (SEQ ID NO:457) of a native sequence PRO1131 cDNA, wherein SEQ ID NO:457 is a clone designated herein as "DNA59777-1480".

FIG. 458 shows the amino acid sequence (SEQ ID NO:458) derived from the coding sequence of SEQ ID NO:457 shown in FIG. 457.

FIG. 459 shows a nucleotide sequence (SEQ ID NO:459) of a native sequence PRO1130 cDNA, wherein SEQ ID NO:459 is a clone designated herein as "DNA59814-1486".

FIG. 460 shows the amino acid sequence (SEQ ID NO:460) derived from the coding sequence of SEQ ID NO:459 shown in FIG. 459.

FIG. 461 shows a nucleotide sequence (SEQ ID NO:461) of a native sequence PRO844 cDNA, wherein SEQ ID NO:461 is a clone designated herein as "DNA59839-1461".

FIG. 462 shows the amino acid sequence (SEQ ID NO:462) derived from the coding sequence of SEQ ID NO:461 shown in FIG. 461.

FIG. 463 shows a nucleotide sequence (SEQ ID NO:463) of a native sequence PRO1154 cDNA, wherein SEQ ID NO:463 is a clone designated herein as "DNA59846-1503".

FIG. 464 shows the amino acid sequence (SEQ ID NO:464) derived from the coding sequence of SEQ ID NO:463 shown in FIG. 463.

FIG. 465 shows a nucleotide sequence (SEQ ID NO:465) of a native sequence PRO1181 cDNA, wherein SEQ ID NO:465 is a clone designated herein as "DNA59847-1511".

FIG. 466 shows the amino acid sequence (SEQ ID NO:466) derived from the coding sequence of SEQ ID NO:465 shown in FIG. 465.

FIG. 467 shows a nucleotide sequence (SEQ ID NO:467) of a native sequence PRO1126 cDNA, wherein SEQ ID NO:467 is a clone designated herein as "DNA60615-1483".

FIG. 468 shows the amino acid sequence (SEQ ID NO:468) derived from the coding sequence of SEQ ID NO:467 shown in FIG. 467.

FIG. 469 shows a nucleotide sequence (SEQ ID NO:469) of a native sequence PRO1186 cDNA, wherein SEQ ID NO:469 is a clone designated herein as "DNA60621-1516".

FIG. 470 shows the amino acid sequence (SEQ ID NO:470) derived from the coding sequence of SEQ ID NO:469 shown in FIG. 469.

FIG. 471 shows a nucleotide sequence (SEQ ID NO:471) of a native sequence PRO1198 cDNA, wherein SEQ ID NO:471 is a clone designated herein as "DNA60622-1525".

FIG. 472 shows the amino acid sequence (SEQ ID NO:472) derived from the coding sequence of SEQ ID NO:471 shown in FIG. 471.

FIG. 473 shows a nucleotide sequence (SEQ ID NO:473) of a native sequence PRO1159 cDNA, wherein SEQ ID NO:473 is a clone designated herein as "DNA60627-1508".

FIG. 474 shows the amino acid sequence (SEQ ID NO:474) derived from the coding sequence of SEQ ID NO:473 shown in FIG. 473.

FIG. 475 shows a nucleotide sequence (SEQ ID NO:475) of a native sequence PRO1265 cDNA, wherein SEQ ID NO:475 is a clone designated herein as "DNA60764-1533".

FIG. 476 shows the amino acid sequence (SEQ ID NO:476) derived from the coding sequence of SEQ ID NO:475 shown in FIG. 475.

FIG. 477 shows a nucleotide sequence (SEQ ID NO:477) of a native sequence PRO1250 cDNA, wherein SEQ ID NO:477 is a clone designated herein as "DNA60775-1532".

FIG. 478 shows the amino acid sequence (SEQ ID NO:478) derived from the coding sequence of SEQ ID NO:477 shown in FIG. 477.

FIG. 479 shows a nucleotide sequence (SEQ ID NO:479) of a native sequence PRO1475 cDNA, wherein SEQ ID NO:479 is a clone designated herein as "DNA61185-1646".

FIG. 480 shows the amino acid sequence (SEQ ID NO:480) derived from the coding sequence of SEQ ID NO:479 shown in FIG. 479.

FIG. 481 shows a nucleotide sequence (SEQ ID NO:481) of a native sequence PRO1312 cDNA, wherein SEQ ID NO:481 is a clone designated herein as "DNA61873-1574".

FIG. 482 shows the amino acid sequence (SEQ ID NO:482) derived from the coding sequence of SEQ ID NO:481 shown in FIG. 481.

FIG. 483 shows a nucleotide sequence (SEQ ID NO:483) of a native sequence PRO1308 cDNA, wherein SEQ ID NO:483 is a clone designated herein as "DNA62306-1570".

FIG. 484 shows the amino acid sequence (SEQ ID NO:484) derived from the coding sequence of SEQ ID NO:483 shown in FIG. 483.

FIG. 485 shows a nucleotide sequence (SEQ ID NO:485) of a native sequence PRO1326 cDNA, wherein SEQ ID NO:485 is a clone designated herein as "DNA62808-1582".

FIG. 486 shows the amino acid sequence (SEQ ID NO:486) derived from the coding sequence of SEQ ID NO:485 shown in FIG. 485.

FIG. 487 shows a nucleotide sequence (SEQ ID NO:487) of a native sequence PRO1192 cDNA, wherein SEQ ID NO:487 is a clone designated herein as "DNA62814-1521".

FIG. 488 shows the amino acid sequence (SEQ ID NO:488) derived from the coding sequence of SEQ ID NO:487 shown in FIG. 487.

FIG. 489 shows a nucleotide sequence (SEQ ID NO:489) of a native sequence PRO1246 cDNA, wherein SEQ ID NO:489 is a clone designated herein as "DNA64885-1529".

FIG. 490 shows the amino acid sequence (SEQ ID NO:490) derived from the coding sequence of SEQ ID NO:489 shown in FIG. 489.

FIG. 491 shows a nucleotide sequence (SEQ ID NO:491) of a native sequence PRO1356 cDNA, wherein SEQ ID NO:491 is a clone designated herein as "DNA64886-1601".

FIG. 492 shows the amino acid sequence (SEQ ID NO:492) derived from the coding sequence of SEQ ID NO:491 shown in FIG. 491.

FIG. 493 shows a nucleotide sequence (SEQ ID NO:493) of a native sequence PRO1275 cDNA, wherein SEQ ID NO:493 is a clone designated herein as "DNA64888-1542".

FIG. 494 shows the amino acid sequence (SEQ ID NO:494) derived from the coding sequence of SEQ ID NO:493 shown in FIG. 493.

FIG. 495 shows a nucleotide sequence (SEQ ID NO:495) of a native sequence PRO1274 cDNA, wherein SEQ ID NO:495 is a clone designated herein as "DNA64889-1541".

FIG. 496 shows the amino acid sequence (SEQ ID NO:496) derived from the coding sequence of SEQ ID NO:495 shown in FIG. 495.

FIG. 497 shows a nucleotide sequence (SEQ ID NO:497) of a native sequence PRO1358 cDNA, wherein SEQ ID NO:497 is a clone designated herein as "DNA64890-1612".

FIG. 498 shows the amino acid sequence (SEQ ID NO:498) derived from the coding sequence of SEQ ID NO:497 shown in FIG. 497.

FIG. 499 shows a nucleotide sequence (SEQ ID NO:499) of a native sequence PRO1286 cDNA, wherein SEQ ID NO:499 is a clone designated herein as "DNA64903-1553".

FIG. 500 shows the amino acid sequence (SEQ ID NO:500) derived from the coding sequence of SEQ ID NO:499 shown in FIG. 499.

FIG. 501 shows a nucleotide sequence (SEQ ID NO:501) of a native sequence PRO1294 cDNA, wherein SEQ ID NO:501 is a clone designated herein as "DNA64905-1558".

FIG. 502 shows the amino acid sequence (SEQ ID NO:502) derived from the coding sequence of SEQ ID NO:501 shown in FIG. 501.

FIG. 503 shows a nucleotide sequence (SEQ ID NO:503) of a native sequence PRO1273 cDNA, wherein SEQ ID NO:503 is a clone designated herein as "DNA65402-1540".

FIG. 504 shows the amino acid sequence (SEQ ID NO:504) derived from the coding sequence of SEQ ID NO:503 shown in FIG. 503.

FIG. 505 shows a nucleotide sequence (SEQ ID NO:505) of a native sequence PRO1279 cDNA, wherein SEQ ID NO:505 is a clone designated herein as "DNA65405-1547".

FIG. 506 shows the amino acid sequence (SEQ ID NO:506) derived from the coding sequence of SEQ ID NO:505 shown in FIG. 505.

FIG. 507 shows a nucleotide sequence (SEQ ID NO:507) of a native sequence PRO1195 cDNA, wherein SEQ ID NO:507 is a clone designated herein as "DNA65412-1523".

FIG. 508 shows the amino acid sequence (SEQ ID NO:508) derived from the coding sequence of SEQ ID NO:507 shown in FIG. 507.

FIG. 509 shows a nucleotide sequence (SEQ ID NO:509) of a native sequence PRO1271 cDNA, wherein SEQ ID NO:509 is a clone designated herein as "DNA66309-1538".

FIG. 510 shows the amino acid sequence (SEQ ID NO:510) derived from the coding sequence of SEQ ID NO:509 shown in FIG. 509.

FIG. 511 shows a nucleotide sequence (SEQ ID NO:511) of a native sequence PRO1338 cDNA, wherein SEQ ID NO:511 is a clone designated herein as "DNA66667-1596".

FIG. 512 shows the amino acid sequence (SEQ ID NO:512) derived from the coding sequence of SEQ ID NO:51 shown in FIG. 511.

FIG. 513 shows a nucleotide sequence (SEQ ID NO:513) of a native sequence PRO1343 cDNA, wherein SEQ ID NO:513 is a clone designated herein as "DNA66675-1587".

FIG. 514 shows the amino acid sequence (SEQ ID NO:514) derived from the coding sequence of SEQ ID NO:513 shown in FIG. 513.

FIG. 515 shows a nucleotide sequence (SEQ ID NO:515) of a native sequence PRO1434 cDNA, wherein SEQ ID NO:515 is a clone designated herein as "DNA68818-2536".

FIG. 516 shows the amino acid sequence (SEQ ID NO:516) derived from the coding sequence of SEQ ID NO:515 shown in FIG. 515.

FIG. 517 shows a nucleotide sequence (SEQ ID NO:517) of a native sequence PRO1418 cDNA, wherein SEQ ID NO:517 is a clone designated herein as "DNA68864-1629".

FIG. 518 shows the amino acid sequence (SEQ ID NO:518) derived from the coding sequence of SEQ ID NO:517 shown in FIG. 517.

FIG. 519 shows a nucleotide sequence (SEQ ID NO:519) of a native sequence PRO1387 cDNA, wherein SEQ ID NO:519 is a clone designated herein as "DNA68872-1620".

FIG. 520 shows the amino acid sequence (SEQ ID NO:520) derived from the coding sequence of SEQ ID NO:519 shown in FIG. 519.

FIG. 521 shows a nucleotide sequence (SEQ ID NO:521) of a native sequence PRO1384 cDNA, wherein SEQ ID NO:521 is a clone designated herein as "DNA71159-1617".

FIG. 522 shows the amino acid sequence (SEQ ID NO:522) derived from the coding sequence of SEQ ID NO:521 shown in FIG. 521.

FIG. 523 shows a nucleotide sequence (SEQ ID NO:523) of a native sequence PRO1565 cDNA, wherein SEQ ID NO:523 is a clone designated herein as "DNA73727-1673".

FIG. 524 shows the amino acid sequence (SEQ ID NO:524) derived from the coding sequence of SEQ ID NO:523 shown in FIG. 523.

FIG. 525 shows a nucleotide sequence (SEQ ID NO:525) of a native sequence PRO1474 cDNA, wherein SEQ ID NO:525 is a clone designated herein as "DNA73739-1645".

FIG. 526 shows the amino acid sequence (SEQ ID NO:526) derived from the coding sequence of SEQ ID NO:525 shown in FIG. 525.

FIG. 527 shows a nucleotide sequence (SEQ ID NO:527) of a native sequence PRO1917 cDNA, wherein SEQ ID NO:527 is a clone designated herein as "DNA76400-2528".

FIG. 528 shows the amino acid sequence (SEQ ID NO:528) derived from the coding sequence of SEQ ID NO:527 shown in FIG. 527.

FIG. 529 shows a nucleotide sequence (SEQ ID NO:529) of a native sequence PRO1787 cDNA, wherein SEQ ID NO:529 is a clone designated herein as "DNA76510-2504".

FIG. 530 shows the amino acid sequence (SEQ ID NO:530) derived from the coding sequence of SEQ ID NO:529 shown in FIG. 529.

FIG. 531 shows a nucleotide sequence (SEQ ID NO:531) of a native sequence PRO1556 cDNA, wherein SEQ ID NO:531 is a clone designated herein as "DNA76529-1666".

FIG. 532 shows the amino acid sequence (SEQ ID NO:532) derived from the coding sequence of SEQ ID NO:531 shown in FIG. 531.

FIG. 533 shows a nucleotide sequence (SEQ ID NO:533) of a native sequence PRO1561 cDNA, wherein SEQ ID NO:533 is a clone designated herein as "DNA76538-1670".

FIG. 534 shows the amino acid sequence (SEQ ID NO:534) derived from the coding sequence of SEQ ID NO:533 shown in FIG. 533.

FIG. 535 shows a nucleotide sequence (SEQ ID NO:535) of a native sequence PRO1693 cDNA, wherein SEQ ID NO:535 is a clone designated herein as "DNA77301-1708".

FIG. 536 shows the amino acid sequence (SEQ ID NO:536) derived from the coding sequence of SEQ ID NO:535 shown in FIG. 535.

FIG. 537 shows a nucleotide sequence (SEQ ID NO:537) of a native sequence PRO1868 cDNA, wherein SEQ ID NO:537 is a clone designated herein as "DNA77624-2515".

FIG. 538 shows the amino acid sequence (SEQ ID NO:538) derived from the coding sequence of SEQ ID NO:537 shown in FIG. 537.

FIG. 539 shows a nucleotide sequence (SEQ ID NO:539) of a native sequence PRO1890 cDNA, wherein SEQ ID NO:539 is a clone designated herein as "DNA79230-2525".

FIG. 540 shows the amino acid sequence (SEQ ID NO:540) derived from the coding sequence of SEQ ID NO:539 shown in FIG. 539.

FIG. 541 shows a nucleotide sequence (SEQ ID NO:541) of a native sequence PRO1887 cDNA, wherein SEQ ID NO:541 is a clone designated herein as "DNA79862-2522".

FIG. 542 shows the amino acid sequence (SEQ ID NO:542) derived from the coding sequence of SEQ ID NO:541 shown in FIG. 541.

FIG. 543 shows a nucleotide sequence (SEQ ID NO:543) of a native sequence PRO4353 cDNA, wherein SEQ ID NO:543 is a clone designated herein as "DNA80145-2594".

FIG. 544 shows the amino acid sequence (SEQ ID NO:544) derived from the coding sequence of SEQ ID NO:543 shown in FIG. 543.

FIG. 545 shows a nucleotide sequence (SEQ ID NO:545) of a native sequence PRO1801 cDNA, wherein SEQ ID NO:545 is a clone designated herein as "DNA83500-2506".

FIG. 546 shows the amino acid sequence (SEQ ID NO:546) derived from the coding sequence of SEQ ID NO:545 shown in FIG. 545.

FIG. 547 shows a nucleotide sequence (SEQ ID NO:547) of a native sequence PRO4357 cDNA, wherein SEQ ID NO:547 is a clone designated herein as "DNA84917-2597".

FIG. 548 shows the amino acid sequence (SEQ ID NO:548) derived from the coding sequence of SEQ ID NO:547 shown in FIG. 547.

FIG. 549 shows a nucleotide sequence (SEQ ID NO:549) of a native sequence PRO4302 cDNA, wherein SEQ ID NO:549 is a clone designated herein as "DNA92218-2554".

FIG. 550 shows the amino acid sequence (SEQ ID NO:550) derived from the coding sequence of SEQ ID NO:549 shown in FIG. 549.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety,of sources, such as from human tissue types or from another source, or prepared by recombinant or synthetic methods. The term "PRO polypeptide" refers to each individual PRO/number polypeptide disclosed herein. All disclosures in this specification which refer to the "PRO polypeptide" refer to each of the polypeptides individually as well as jointly. For example, descriptions of the preparation of, purification of, derivation of, formation of antibodies to or against, administration of, compositions containing, treatment of a disease with, etc., pertain to each polypeptide of the invention individually. The term "PRO polypeptide" also includes variants of the PRO/number polypeptides disclosed herein.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position I in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are contemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1-6 (1997) and von Heinje et al., *Nucl. Acids. Res.* 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, alternatively at least about 20 amino acids in length, alternatively at least about 30 amino acids in length, alternatively at least about 40 amino acids in length, alternatively at least about 50 amino acids in length, alternatively at least about 60 amino acids in length, alternatively at least about 70 amino acids in length, alternatively at least about 80 amino acids in length, alternatively at least about 90 amino acids in length, alternatively at least about 100 amino acids in length, alternatively at least about 150 amino acids in length, alternatively at least about 200 amino acids in length, alternatively at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital ULNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X," "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res*. 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length={fraction (15/5)}, multi-pass e-value=0.01, constant for multi-pass25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, alternatively at least about 60 nucleotides in length, alternatively at least about 90 nucleotides in length, alternatively at least about 120 nucleotides in length, alternatively at least about 150 nucleotides in length, alternatively at least about 180 nucleotides in length, alternatively at least about 210 nucleotides in length, alternatively at least about 240 nucleotides in length, alternatively at least about 270 nucleotides in length, alternatively at least about 300 nucleotides in length, alternatively at least about 450 nucleotides in length, alternatively at least about 600 nucleotides in length, alternatively at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., *Nucleic Acids Res.* 25:3389-3402 (1997)). The NCBI-BLAST2 sequence comparison program may be obtained from the National Institute of Health, Bethesda, Md. NCBJ-BLAST2 uses several search parameters, wherein all of those search parameters are set to default values including, for example, unmask=yes, strand=all, expected occurrences=10, minimum low complexity length={fraction (15/5)}, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mN sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesion") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesion part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444-6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or non-reducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

An antibody that "specifically binds to" or is "specific for" a particular polypeptide or an epitope on a particular polypeptide is one that binds to that particular polypeptide or epitope on a particular polypeptide without substantially binding to any other polypeptide or polypeptide epitope.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylarides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

An "effective amount" of a polypeptide disclosed herein or an agonist or antagonist thereof is an amount sufficient to carry out a specifically stated purpose. An "effective amount" may be determined empirically and in a routine manner, in relation to the stated purpose.

Table 1

```
/*
 *
 * C-C increased from 12 to 15
 * Z is average of EQ
 * B is average of ND
 * match with stop is _M; stop-stop = 0; J (joker) match = 0
 */
define  _M    -8       /* value of a match with a stop */ int      _day[26][26] = {
/*       A  B  C  D  E  F  G  H  I  J  K  L  M  N  O  P  Q  R  S  T  U  V  W  X  Y  Z */
/* A */ { 2, 0,-2, 0, 0,-4, 1,-1,-1, 0,-1,-2,-1, 0,_M, 1, 0,-2, 1, 1, 0, 0,-6, 0,-3, 0},
/* B */ { 0, 3,-4, 3, 2,-5, 0, 1,-2, 0, 0,-3,-2, 2,_M,-1, 1, 0, 0, 0, 0,-2,-5, 0,-3, 1},
/* C */ {-2,-4,15,-5,-5,-4,-3,-3,-2, 0,-5,-6,-5,-4,_M,-3,-5,-4, 0,-2, 0,-2,-8, 0, 0,-5},
/* D */ { 0, 3,-5, 4, 3,-6, 1, 1,-2, 0, 0,-4,-3, 2,_M,-1, 2,-1, 0, 0, 0,-2,-7, 0,-4, 2},
/* E */ { 0, 2,-5, 3, 4,-5, 0, 1,-2, 0, 0,-3,-2, 1,_M,-1, 2,-1, 0, 0, 0,-2,-7, 0,-4, 3},
/* F */ {-4,-5,-4,-6,-5, 9,-5,-2, 1, 0,-5, 2, 0,-4,_M,-5,-5,-4,-3,-3, 0,-1, 0, 0, 7,-5},
/* G */ { 1, 0,-3, 1, 0,-5, 5,-2,-3, 0,-2,-4,-3, 0,_M,-1,-1,-3, 1, 0, 0,-1,-7, 0,-5, 0},
/* H */ {-1, 1,-3, 1, 1,-2,-2, 6,-2, 0, 0,-2,-2, 2,_M, 0, 3, 2,-1,-1, 0,-2,-3, 0, 0, 2},
/* I */ {-1,-2,-2,-2,-2, 1,-3,-2, 5, 0,-2, 2, 2,-2,_M,-2,-2,-2,-1, 0, 0, 4,-5, 0,-1,-2},
/* J */ { 0, 0, 0, 0, 0, 0, 0, 0, 0, 0, 0, 0, 0, 0,_M, 0, 0, 0, 0, 0, 0, 0, 0, 0, 0, 0},
/* K */ {-1, 0,-5, 0, 0,-5,-2, 0,-2, 0, 5,-3, 0, 1,_M,-1, 1, 3, 0, 0, 0,-2,-3, 0,-4, 0},
/* L */ {-2,-3,-6,-4,-3, 2,-4,-2, 2, 0,-3, 6, 4,-3,_M,-3,-2,-3,-3,-1, 0, 2,-2, 0,-1,-2},
/* M */ {-1,-2,-5,-3,-2, 0,-3,-2, 2, 0, 0, 4, 6,-2,_M,-2,-1, 0,-2,-1, 0, 2,-4, 0,-2,-1},
/* N */ { 0, 2,-4, 2, 1,-4, 0, 2,-2, 0, 1,-3,-2, 2,_M,-1, 1, 0, 1, 0, 0,-2,-4, 0,-2, 1},
/* O */ {_M,_M,_M,_M,_M,_M,_M,_M,_M,_M,_M,_M,_M,_M, 0,_M,_M,_M,_M,_M,_M,_M,_M,_M,_M,_M},
/* P */ { 1,-1,-3,-1,-1,-5,-1, 0,-2, 0,-1,-3,-2,-1,_M, 6, 0, 0, 1, 0, 0,-1,-6, 0,-5, 0},
/* Q */ { 0, 1,-5, 2, 2,-5,-1, 3,-2, 0, 1,-2,-1, 1,_M, 0, 4, 1,-1,-1, 0,-2,-5, 0,-4, 3},
/* R */ {-2, 0,-4,-1,-1,-4,-3, 2,-2, 0, 3,-3, 0, 0,_M, 0, 1, 6, 0,-1, 0,-2, 2, 0,-4, 0},
/* S */ { 1, 0, 0, 0, 0,-3, 1,-1,-1, 0, 0,-3,-2, 1,_M, 1,-1, 0, 2, 1, 0,-1,-2, 0,-3, 0},
/* T */ { 1, 0,-2, 0, 0,-3, 0,-1, 0, 0, 0,-1,-1, 0,_M, 0,-1,-1, 1, 3, 0, 0,-5, 0,-3, 0},
/* U */ { 0, 0, 0, 0, 0, 0, 0, 0, 0, 0, 0, 0, 0, 0,_M, 0, 0, 0, 0, 0, 0, 0, 0, 0, 0, 0},
/* V */ { 0,-2,-2,-2,-2,-1,-1,-2, 4, 0,-2, 2, 2,-2,_M,-1,-2,-2,-1, 0, 0, 4,-6, 0,-2,-2},
/* W */ {-6,-5,-8,-7,-7, 0,-7,-3,-5, 0,-3,-2,-4,-4,_M,-6,-5, 2,-2,-5, 0,-6,17, 0, 0,-6},
/* X */ { 0, 0, 0, 0, 0, 0, 0, 0, 0, 0, 0, 0, 0, 0,_M, 0, 0, 0, 0, 0, 0, 0, 0, 0, 0, 0},
/* Y */ {-3,-3, 0,-4,-4, 7,-5, 0,-1, 0,-4,-1,-2,-2,_M,-5,-4,-4,-3,-3, 0,-2, 0, 0,10,-4},
/* Z */ { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
 */
#include <stdio.h>
include <ctype.h> define MAXJMP   16      /* max jumps in a diag */
define MAXGAP   24      /* don't continue to penalize gaps larger than this */
#define JMPS     1024    /* max jmps in an path */
define MX       4       /* save if there's at least MX-1 bases since last jmp */ define DMAT     3       /* value of matching bases */
define DMIS     0       /* penalty for mismatched bases */
#define DINS0    8       /* penalty for a gap */
#define DINS1    1       /* penalty per base */
#define PINS0    8       /* penalty for a gap */
define PINS1    4       /* penalty per residue */ struct jmp {
        short          n[MAXJMP];        /* size of jmp (neg for dely) */
        unsigned short x[MAXJMP];        /* base no. of jmp in seq x */
};                                       /* limits seq to 2^16 -1 */ struct diag {
        int       score;         /* score at last jmp */
        long      offset;        /* offset of prev block */
        short     ijmp;          /* current jmp index */
        struct jmp jp;           /* list of jmps */
};

struct path {
        int    spc;              /* number of leading spaces */
        short  n[JMPS];/* size of jmp (gap) */
        int    x[JMPS];/* loc of jmp (last elem before gap) */
};

char         *ofile;             /* output file name */
char         *namex[2];          /* seq names: getseqs() */
char         *prog;              /* prog name for err msgs */
char         *seqx[2];           /* seqs: getseqs() */
int          dmax;               /* best diag: nw() */
int          dmax0;              /* final diag */
int          dna;                /* set if dna: main() */
int          endgaps;            /* set if penalizing end gaps */
int          gapx, gapy;         /* total gaps in seqs */
int          len0, len1;         /* seq lens */
int          ngapx, ngapy;       /* total size of gaps */
int          smax;               /* max score: nw() */
int          *xbm;               /* bitmap for matching */
long         offset;             /* current offset in jmp file */
struct diag  *dx;                /* holds diagonals */
struct path  pp[2];              /* holds path for seqs */ char  *calloc(), *malloc(), *index(), *strcpy();
char  *getseq(), *g_calloc();
```

Table 1 (cont')

```
/* Needleman-Wunsch alignment program
 *
 * usage: progs file1 file2
 *   where file1 and file2 are two dna or two protein sequences.
 *   The sequences can be in upper- or lower-case an may contain ambiguity
 *   Any lines beginning with ';', '>' or '<' are ignored
 *   Max file length is 65535 (limited by unsigned short x in the jmp struct)
 *   A sequence with 1/3 or more of its elements ACGTU is assumed to be DNA
 *   Output is in the file "align.out"
 *
 * The program may create a tmp file in /tmp to hold info about traceback.
 * Original version developed under BSD 4.3 on a vax 8650
 */
include "nw.h"
#include "day.h"

static    _dbval[26] = {
          1,14,2,13,0,0,4,11,0,0,12,0,3,15,0,0,0,5,6,8,8,7,9,0,10,0
};

static    _pbval[26] = {
          1, 2|(1<<('D'-'A'))|(1<<('N'-'A')), 4, 8, 16, 32, 64,
          128, 256, 0xFFFFFFF, 1<<10, 1<<11, 1<<12, 1<<13, 1<<14,
          1<<15, 1<<16, 1<<17, 1<<18, 1<<19, 1<<20, 1<<21, 1<<22,
          1<<23, 1<<24, 1<<25|(1<<('E'-'A'))|(1<<('Q'-'A'))
};

main(ac, av)                                                                    main
          int       ac;
          char      *av[];
{
          prog = av[0];
          if (ac != 3) {
                    fprintf(stderr,"usage: %s file1 file2\n", prog);
                    fprintf(stderr,"where file1 and file2 are two dna or two protein sequences.\n");
                    fprintf(stderr,"The sequences can be in upper- or lower-case\n");
                    fprintf(stderr,"Any lines beginning with ';' or '<' are ignored\n");
                    fprintf(stderr,"Output is in the file \"align.out\"\n");
                    exit(1);
          }
          namex[0] = av[1];
          namex[1] = av[2];
          seqx[0] = getseq(namex[0], &len0);
          seqx[1] = getseq(namex[1], &len1);
          xbm = (dna)? _dbval : _pbval;

endgaps = 0;              /* 1 to penalize endgaps */
          ofile = "align.out";      /* output file */ nw();                     /* fill in the matrix, get the possible jmps */
          readjmps();               /* get the actual jmps */
          print();                  /* print stats, alignment */ cleanup(0);               /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw()                                                                              nw
{
        char        *px, *py;         /* seqs and ptrs */
        int         *ndely, *dely;    /* keep track of dely */
        int         ndelx, delx;      /* keep track of delx */
        int         *tmp;             /* for swapping row0, row1 */
        int         mis;              /* score for each type */
        int         ins0, ins1;       /* insertion penalties */
        register    id;               /* diagonal index */
        register    ij;               /* jmp index */
        register    *col0, *col1;     /* score for curr, last row */
        register    xx, yy;           /* index into seqs */ dx = (struct diag *)g_calloc("to get diags", len0+len1+1, sizeof(struct diag));

ndely = (int *)g_calloc("to get ndely", len1+1, sizeof(int));
        dely = (int *)g_calloc("to get dely", len1+1, sizeof(int));
        col0 = (int *)g_calloc("to get col0", len1+1, sizeof(int));
        col1 = (int *)g_calloc("to get col1", len1+1, sizeof(int));
        ins0 = (dna)? DINS0 : PINS0;
        ins1 = (dna)? DINS1 : PINS1;

smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;            /* Waterman Bull Math Biol 84 */
        }
        else
                for (yy = 1; yy <= len1; yy++)
                        dely[yy] = -ins0;

/* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

/* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

/* pick the maximum score; we're favoring
         * mis over any del and delx over dely
         */
```

Table 1 (cont')

...nw

```
                    id = xx - yy + len1 - 1;
                    if (mis >= delx && mis >= dely[yy])
                            col1[yy] = mis;
                    else if (delx >= dely[yy]) {
                            col1[yy] = delx;
                            ij = dx[id].ijmp;
                            if (dx[id].jp.n[0] && (!dna || (ndelx >= MAXJMP
                                && xx > dx[id].jp.x[ij]+MX) || mis > dx[id].score+DINS0)) {
                                    dx[id].ijmp++;
                                    if (++ij >= MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = ndelx;
                            dx[id].jp.x[ij] = xx;
                            dx[id].score = delx;
                    }
                    else {
                            col1[yy] = dely[yy];
                            ij = dx[id].ijmp;
            if (dx[id].jp.n[0] && (!dna || (ndely[yy] >= MAXJMP
                && xx > dx[id].jp.x[ij]+MX) || mis > dx[id].score+DINS0)) {
                                    dx[id].ijmp++;
                                    if (++ij >= MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = -ndely[yy];
                            dx[id].jp.x[ij] = xx;
                            dx[id].score = dely[yy];
                    }
                    if (xx == len0 && yy < len1) {
                            /* last col
                             */
                            if (endgaps)
                                    col1[yy] -= ins0+ins1*(len1-yy);
                            if (col1[yy] > smax) {
                                    smax = col1[yy];
                                    dmax = id;
                            }
                    }
            }
            if (endgaps && xx < len0)
                    col1[yy-1] -= ins0+ins1*(len0-xx);
            if (col1[yy-1] > smax) {
                    smax = col1[yy-1];
                    dmax = id;
            }
            tmp = col0; col0 = col1; col1 = tmp;
    }
    (void) free((char *)ndely);
    (void) free((char *)dely);
    (void) free((char *)col0);
```

```
(void) free((char *)col1);                    }
```

Table 1 (cont')

```
/*
 *
 * print() -- only routine visible outside this module
 *
 * static:
 * getmat() -- trace back best path, count matches: print()
 * pr_align() -- print alignment of described in array p[]: print()
 * dumpblock() -- dump a block of lines with numbers, stars: pr_align()
 * nums() -- put out a number line: dumpblock()
 * putline() -- put out a line (name, [num], seq, [num]): dumpblock()
 * stars() - -put a line of stars: dumpblock()
 * stripname() -- strip any path and prefix from a seqname
 */ include "nw.h"

define SPC      3
#define P_LINE   256     /* maximum output line */
define P_SPC    3       /* space between name or num and seq */ extern   _day[26][26];
int      olen;           /* set output line length */
FILE     *fx;            /* output file */ print()
{
        int     lx, ly, firstgap, lastgap;      /* overlap */ if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align();
}
``` print

Table 1 (cont')

```
/*
 * trace back the best path, count matches
 */
static
getmat(lx, ly, firstgap, lastgap)                                               getmat
        int     lx, ly;                /* "core" (minus endgaps) */
        int     firstgap, lastgap;     /* leading trailing overlap */
{
        int             nm, i0, i1, siz0, siz1;
        char            outx[32];
        double          pct;
        register        n0, n1;
        register char   *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, "<%d match%s in an overlap of %d: %.2f percent similarity\n",
                nm, (nm == 1)? "" : "es", lx, pct);
```

Table 1 (cont')

```
            fprintf(fx, "<gaps in first sequence: %d", gapx);                                    ...getmat
            if (gapx) {
                    (void) sprintf(outx, " (%d %s%s)",
                            ngapx, (dna)? "base":"residue", (ngapx == 1)? "":"s");
                    fprintf(fx,"%s", outx);

fprintf(fx, ", gaps in second sequence: %d", gapy);
            if (gapy) {
                    (void) sprintf(outx, " (%d %s%s)",
                            ngapy, (dna)? "base":"residue", (ngapy == 1)? "":"s");
                    fprintf(fx,"%s", outx);
            }
            if (dna)
                    fprintf(fx,
                    "\n<score: %d (match = %d, mismatch = %d, gap penalty = %d + %d per base)\n",
                    smax, DMAT, DMIS, DINS0, DINS1);
            else
                    fprintf(fx,
                    "\n<score: %d (Dayhoff PAM 250 matrix, gap penalty = %d + %d per residue)\n",
                    smax, PINS0, PINS1);
            if (endgaps)
                    fprintf(fx,
                    "<endgaps penalized. left endgap: %d %s%s, right endgap: %d %s%s\n",
                    firstgap, (dna)? "base" : "residue", (firstgap == 1)? "" : "s",
                    lastgap, (dna)? "base" : "residue", (lastgap == 1)? "" : "s");
            else
                    fprintf(fx, "<endgaps not penalized\n");
}
static          nm;                     /* matches in core -- for checking */
static          lmax;                   /* lengths of stripped file names */
static          ij[2];                  /* jmp index for a path */
static          nc[2];                  /* number at start of current line */
static          ni[2];                  /* current elem number -- for gapping */
static          siz[2];
static char     *ps[2];                 /* ptr to current element */
static char     *po[2];                 /* ptr to next output char slot */
static char     out[2][P_LINE];         /* output line */
static char     star[P_LINE];           /* set by stars() */

/*
* print alignment of described in struct path pp[]
*/
static
pr_align()                                                                                       pr_align
{
            int         nn;      /* char count */
            int         more;
            register    i;

for (i = 0, lmax = 0; i < 2; i++) {
                    nn = stripname(namex[i]);
                    if (nn > lmax)
                            lmax = nn;

nc[i] = 1;
                    ni[i] = 1;
                    siz[i] = ij[i] = 0;
```

```
ps[i] = seqx[i];
po[i] = out[i];                    }
```

Table 1 (cont')

```
for (nn = nm = 0, more = 1; more; ) {                                    ...pr_align
        for (i = more = 0; i < 2; i++) {
                /*
                 * do we have more of this sequence?
                 */
                if (!*ps[i])
                        continue;

more++;

if (pp[i].spc) {        /* leading space */
                        *po[i]++ = ' ';
                        pp[i].spc--;
                }
                else if (siz[i]) {      /* in a gap */
                        *po[i]++ = '-';
                        siz[i]--;
                }
                else {                  /* we're putting a seq element
                                         */
                        *po[i] = *ps[i];
                        if (islower(*ps[i]))
                                *ps[i] = toupper(*ps[i]);
                        po[i]++;
                        ps[i]++;

/*
                         * are we at next gap for this seq?
                         */
                        if (ni[i] == pp[i].x[ij[i]]) {
                                /*
                                 * we need to merge all gaps
                                 * at this location
                                 */
                                siz[i] = pp[i].n[ij[i]++];
                                while (ni[i] == pp[i].x[ij[i]])
                                        siz[i] += pp[i].n[ij[i]++];
                        }
                        ni[i]++;
                }
        }
        if (++nn == olen || !more && nn) {
                dumpblock();
                for (i = 0; i < 2; i++)
                        po[i] = out[i];
                nn = 0;
        }
    }
}
/*
 * dump a block of lines, including numbers, stars: pr_align()
 */
static
dumpblock()                                                              dumpblock
{
        register i;
```

```
for (i = 0; i < 2; i++)
    *po[i]-- = '\0';
```

Table 1 (cont')

```
                (void) putc('\n', fx);                                          ...dumpblock
                for (i = 0; i < 2; i++) {
                        if (*out[i] && (*out[i] != ' ' || *(po[i]) != ' '))
                                if (i == 0)
                                        nums(i);
                                if (i == 0 && *out[1])
                                        stars();
                                putline(i);
                                if (i == 0 && *out[1])
                                        fprintf(fx, star);
                                if (i == 1)
                                        nums(i);
                        }
                }
        }
        /*
         * put out a number line: dumpblock()
         */
        static
        nums(ix)                                                                nums
                int     ix;     /* index in out[] holding seq line */
        {
                char            nline[P_LINE];
                register        i, j;
                register char   *pn, *px, *py;

for (pn = nline, i = 0; i < lmax+P_SPC; i++, pn++)
                        *pn = ' ';
                for (i = nc[ix], py = out[ix]; *py; py++, pn++) {
                        if (*py == ' ' || *py == '-')
                                *pn = ' ';
                        else {
                                if (i%10 == 0 || (i == 1 && nc[ix] != 1)) {
                                        j = (i < 0)? -i : i;
                                        for (px = pn; j; j /= 10, px--)
                                                *px = j%10 + '0';
                                        if (i < 0)
                                                *px = '-';
                                }
                                else
                                        *pn = ' ';
                                i++;
                        }
                }
                *pn = '\0';
                nc[ix] = i;
                for (pn = nline; *pn; pn++)
                        (void) putc(*pn, fx);
                (void) putc('\n', fx);
        }
        /*
         * put out a line (name, [num], seq, [num]): dumpblock()
         */
        static
        putline(ix)                                                             putline
``` int ix; {

Table 1 (cont')

```
        int         i;
        register char   *px;

for (px = namex[ix], i = 0; *px && *px != ':'; px++, i++)
                (void) putc(*px, fx);
        for (; i < lmax+P_SPC; i++)
                (void) putc(' ', fx);

/* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}

/*
 * put a line of stars (seqs always in out[0], out[1]): dumpblock()
 */
static
stars()
{
        int         i;
        register char   *p0, *p1, cx, *px;

if (!*out[0] || (*out[0] == ' ' && *(po[0]) == ' ') ||
            !*out[1] || (*out[1] == ' ' && *(po[1]) == ' '))
                return;
        px = star;
        for (i = lmax+P_SPC; i; i--)
                *px++ = ' ';

for (p0 = out[0], p1 = out[1]; *p0 && *p1; p0++, p1++){
                if (isalpha(*p0) && isalpha(*p1)) { if (xbm[*p0-'A']&xbm[*p1-'A'])
                                cx = '*';
                                nm++;
                        }
                        else if (!dna && _day[*p0-'A'][*p1-'A'] > 0)
                                cx = '.';
                        else
                                cx = ' ';
                }
                else
                        cx = ' ';
                *px++ = cx;
        }
        *px++ = '\n';
        *px = '\0';
}
```

...putline stars

Table 1 (cont')

```
/*
 * strip path or prefix from pn, return len: pr_align()
 */
static
stripname(pn)
        char       *pn;       /* file name (may be path) */
{
        register char    *px, *py;

py = 0;
        for (px = pn; *px; px++)
                if (*px == '/')
                        py = px + 1;
        if (py)
                (void) strcpy(pn, py);
        return(strlen(pn));

}
``` stripname

Table 1 (cont')

```
/*
 * cleanup() -- cleanup any tmp file
 * getseq() -- read in seq, set dna, len, maxlen
 * g_calloc() -- calloc() with error checkin
 * readjmps() -- get the good jmps, from tmp file if necessary
 * writejmps() -- write a filled array of jmps to a tmp file: nw()
 */
include "nw.h"
include <sys/file.h> char      *jname = "/tmp/homgXXXXXX";      /* tmp file for jmps */
FILE      *fj;

int       cleanup();                        /* cleanup tmp file */
long      lseek();

/*
 * remove any tmp file if we blow
 */
cleanup(i)                                                              cleanup
          int       i;
{
          if (fj)
                    (void) unlink(jname);
          exit(i);
}

/*
 * read, return ptr to seq, set dna, len, maxlen
 * skip lines starting with ';', '<', or '>'
 * seq in upper or lower case
 */
char      *
getseq(file, len)                                                       getseq
          char      *file;      /* file name */
          int       *len;       /* seq len */
{
          char              line[1024], *pseq;
          register char     *px, *py;
          int               natgc, tlen;
          FILE              *fp;

if ((fp = fopen(file,"r")) == 0) {
                    fprintf(stderr,"%s: can't read %s\n", prog, file);
                    exit(1);
          }
          tlen = natgc = 0;
          while (fgets(line, 1024, fp)) {
                    if (*line == ';' || *line == '<' || *line == '>')
                              continue;
                    for (px = line; *px != '\n'; px++)
                              if (isupper(*px) || islower(*px))
                                        tlen++;
          }
          if ((pseq = malloc((unsigned)(tlen+6))) == 0) {
                    fprintf(stderr,"%s: malloc() failed to get %d bytes for %s\n", prog, tlen+6, file);
                    exit(1);
          }
          pseq[0] = pseq[1] = pseq[2] = pseq[3] = '\0';
```

Table 1 (cont')

...getseq

```
            py = pseq + 4;
    *len = tlen;
    rewind(fp);

while (fgets(line, 1024, fp)) {
                if (*line == ';' || *line == '<' || *line == '>')
                            continue;
                for (px = line; *px != '\n'; px++){
                            if (isupper(*px))
                                        *py++ = *px;
                            else if (islower(*px))
                                        *py++ = toupper(*px);
                            if (index("ATGCU",*(py-1)))
                                        natgc++;
                }
    }
    *py++ = '\0';
    *py = '\0';
    (void) fclose(fp);
    dna = natgc > (tlen/3);
    return(pseq+4);
} char      *
g_calloc(msg, nx, sz)
    char      *msg;         /* program, calling routine */
    int       nx, sz;       /* number and size of elements */
{
    char      *px, *calloc();

if ((px = calloc((unsigned)nx, (unsigned)sz)) == 0) {
                if (*msg) {
                            fprintf(stderr, "%s: g_calloc() failed %s (n=%d, sz=%d)\n", prog, msg, nx, sz);
                            exit(1);
                }
    }
    return(px);
}

/*
 * get final jmps from dx[] or tmp file, set pp[], reset dmax: main()
 */
readjmps()
{
    int       fd = -1;
    int       siz, i0, i1;
    register  i, j, xx;

if (fj) {
                (void) fclose(fj);
                if ((fd = open(jname, O_RDONLY, 0)) < 0) {
                            fprintf(stderr, "%s: can't open() %s\n", prog, jname);
                            cleanup(1);
                }
    }
    for (i = i0 = i1 = 0, dmax0 = dmax, xx = len0; ; i++) {
                while (1) {
                            for (j = dx[dmax].ijmp; j >= 0 && dx[dmax].jp.x[j] >= xx; j--)
``` g_calloc readjmps

Table 1 (cont')

...readjmps

```
                if (j < 0 && dx[dmax].offset && fj) {
                        (void) lseek(fd, dx[dmax].offset, 0);
                        (void) read(fd, (char *)&dx[dmax].jp, sizeof(struct jmp));
                        (void) read(fd, (char *)&dx[dmax].offset, sizeof(dx[dmax].offset));
                        dx[dmax].ijmp = MAXJMP-1;
                }
                else
                        break;
        }
        if (i >= JMPS) {
                fprintf(stderr, "%s: too many gaps in alignment\n", prog);
                cleanup(1);
        }
        if (j >= 0) {
                siz = dx[dmax].jp.n[j];
                xx = dx[dmax].jp.x[j];
                dmax += siz;
                if (siz < 0) {                  /* gap in second seq */
                        pp[1].n[i1] = -siz;
                        xx += siz;
                        /* id = xx - yy + len1 - 1
                        */
                        pp[1].x[i1] = xx - dmax + len1 - 1;
                        gapy++;
                        ngapy -= siz;
/* ignore MAXGAP when doing endgaps */
                        siz = (-siz < MAXGAP || endgaps)? -siz : MAXGAP;
                        i1++;
                }
                else if (siz > 0) {    /* gap in first seq */
                        pp[0].n[i0] = siz;
                        pp[0].x[i0] = xx;
                        gapx++;
                        ngapx += siz;
/* ignore MAXGAP when doing endgaps */
                        siz = (siz < MAXGAP || endgaps)? siz : MAXGAP;
                        i0++;
                }
        }
        else
                break;
}

/* reverse the order of jmps
*/
for (j = 0, i0--; j < i0; j++, i0--) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
}
for (j = 0, i1--; j < i1; j++, i1--) {
        i = pp[1].n[j]; pp[1].n[j] = pp[1].n[i1]; pp[1].n[i1] = i;
        i = pp[1].x[j]; pp[1].x[j] = pp[1].x[i1]; pp[1].x[i1] = i;
}
if (fd >= 0)
        (void) close(fd);
if (fj) {
        (void) unlink(jname);
        fj = 0;
        offset = 0;
```

}   }

Table 1 (cont')

```
/*
 * write a filled jmp struct offset of the prev one (if any): nw()
 */
writejmps(ix)                                                                    writejmps
        int     ix;
{
        char    *mktemp();

if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| PRO | XXXXXXXXXXXXXXX | (Length = 15 amino acids) |
|---|---|---|
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| PRO | XXXXXXXXXX | (Length = 10 amino acids) |
|---|---|---|
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| PRO-DNA | NNNNNNNNNNNNNN | (Length = 14 nucleotides) |
|---|---|---|
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| PRO-DNA | NNNNNNNNNNNN | (Length = 12 nucleotides) |
|---|---|---|
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

A. Full-Length PRO Polypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:
(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.* 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081-1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.*, 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W.H. Freeman & Co., San Francisco, pp. 79-86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published Sep. 11, 1987, and in Aplin and Wriston, *CRC Crit. Rev. Biochem.*, pp. 259-306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.*, 259:52 (1987) and by Edge et al., *Anal.*

Biochem., 118:131 (1981). Enzymatic cleavage of carbohydrate moieties on polypeptides can be achieved by the use of a variety of endo- and exo-glycosidases as described by Thotakura et al., *Meth. Enzymol.*, 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159-2165 (1988)]; the c-myc tag and the 8F9, 3C7, 6E10, G4, B7 and 9E10 antibodies thereto [Evan et al., *Molecular and Cellular Biology*, 5:3610-3616 (1985)]; and Herpes Simplex virus glycoprotein D (gD) tag and its antibody [Paborsky et al., *Protein Engineering*, 3(6):547-553 (1990)]. Other tag polypeptides include the Flag-peptide [Hopp et al., *BioTechnology*, 6:1204-1210(1988)]; the KT3 epitope peptide [Martin et al., *Science*, 255:192-194 (1992)]; an α-tubulin epitope peptide [Skinner et al., *J. Biol. Chem.*, 266:15163-15166 (1991)]; and the T7 gene 10 protein peptide tag [Lutz-Freyermuth et al., *Proc. Natl. Acad. Sci. USA*, 87:6393-6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W.H. Freeman Co., San Francisco, Calif. (1969); Merrifield, *J. Am. Chem. Soc.*, 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO oroligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, CaCl$_2$, CaPO$_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published Jun. 29, 1989. For mammalian cells without such cell walls, the calcium phosphate precipitation method of Graham and van der Eb, *Virology*, 52:456-457 (1978) can be employed. General aspects of mammalian cell host system transfections have been described in U.S. Pat. No. 4,399,216. Transformations into yeast are typically carried out according to the method of Van Solingen et al., *J. Bact.*, 130:946 (1977) and Hsiao et al., *Proc. Natl. Acad. Sci. (USA)*, 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527-537 (1990) and Mansour et al., *Nature*, 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescans*, and *Shigella*, as well as *Bacilli* such as *B. subtilis* and *B. licheniformis* (e.g., *B. licheniformis* 41P disclosed in DD 266,710 published Apr. 12, 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA ; *E. coli* W3110 strain 9E4, which has the complete genotype tonA ptr3; *E. coli* W3110 strain 27C7 (ATCC 55,244), which has the complete genotype tonA ptr3 phoA E15 (argF-lac)169 degP ompT kan$^r$; *E. coli* W3110 strain 37D6, which has the complete genotype tonA ptr3 phoA E15 (argF-lac)169 degP ompT rbs7 ilvG kan$^r$; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued Aug. 7, 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharomyces pombe* (Beach and Nurse, *Nature*, 290:140 [1981]; EP 139,383 published May 2, 1985); *Kluyveromyces* hosts (U.S. Pat. No. 4,943,529; Fleer et al., *Bio/Technology*, 9:968-975 (1991)) such as, e.g., *K. lactis* (MW98-8C, CBS683, CBS4574; Louvencourt et al., *J. Bacteriol.*, 154(2):737-742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology*, 8:135 (1990)), *K. thermotolerans*, and *K. marxianus; yarrowia* (EP 402,226); *Pichia pastoris* (EP 183,070; Sreekrishna et al., *J. Basic Microbiol.*, 28:265-278 [1988]); Candida; *Trichoderma reesia* (EP 244,234); *Neurospora crassa* (Case et al., *Proc. Natl. Acad. Sci. USA*, 76:5259-5263 [1979]); *Schwanniomyces* such as *Schwanniomyces occidentalis* (EP 394,538 published Oct. 31, 1990); and filamentous fungi such as, e.g., *Neurospora*, *Penicillium*, *Tolypocladium* (WO 91/00357 published Jan. 10, 1991), and *Aspergillus* hosts such as *A. nidulans* (Ballance et al., *Biochem. Biophys. Res. Commun.*, 112:284-289 [1983]; Tilburn et al., *Gene*, 26:205-221 [1983]; Yelton et al., *Proc. Natl. Acad. Sci. USA*, 81: 1470-1474 [1984]) and *A. niger* (Kelly and Hynes, *EMBO J.*, 4:475-479 [1985]). Methylotropic yeasts are suitable herein and include, but are not limited to, yeast capable of growth on methanol selected from the genera consisting of *Hansenula*, *Candida*, *Kloeckera*, *Pichia*, *Saccharomyces*, *Torulopsis*, and *Rhodotorula*. A list of specific species that are exemplary of this class of yeasts may be found in C. Anthony, *The Biochemistry of Methylotrophs*, 269 (1982).

Suitable host cells for the expression of glycosylated PRO are derived from multicellular organisms. Examples of invertebrate cells include insect cells such as Drosophila S2 and Spodoptera Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.*, 36:59 (1977)); Chinese hamster ovary cells/-DHFR (CHO, Urlaub and Chasin, *Proc. Natl. Acad. Sci. USA*, 77:4216(1980)); mouse sertoli cells (TM4, Mather, *Biol. Reprod.*, 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art 3. Selection and Use of a Replicable Vector The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be apart of the PRO-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including Saccharomyces and Kluyveromyces α-factor leaders, the latter described in U.S. Pat. No. 5,010,182), or acid phosphatase leader, the C. albicans glucoamylase leader (EP 362,179 published Apr. 4, 1990), or the signal described in WO 90/13646 published Nov. 15, 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., Proc. Natl. Acad. Sci. USA, 77:4216 (1980). A suitable selection gene for use in yeast is the trp1 gene present in the yeast plasmid YRp7 [Stinchcomb et al., Nature, 282:39 (1979); Kingsman et al., Gene, 7:141 (1979); Tschemper et al., Gene, 10:157 (1980)]. The trp1 gene provides a selection marker for a mutant strain of yeast lacking the ability to grow in tryptophan, for example, ATCC No. 44076 or PEP4-1 [Jones, Genetics, 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., J. Biol. Chem., 255:2073 (1980)] or other glycolytic enzymes [Hess et al., J. Adv. Enzyme Reg., 7:149 (1968); Holland, Biochemistry, 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochromeC, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., Nature, 293:620-625 (1981); Mantei et al., Nature, 281:40-46 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology*, 182 (1990); Scopes, *Protein Purification: Principles and Practice*, Springer-Verlag, New York (1982). The purification step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the full-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidin/biotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $CaPO_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode PRO or its modified forms can also be used to generate either uransgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as in mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell,* 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell,* 69:915 (1992)]. The selected cells are then injected into a blastocyst of an animal (e.g., a mouse or rat) to form aggregation chimeras [see e.g., Bradley, in *Teratocarcinomas and Embryonic Stem Cells: A Practical Approach*, E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knock-out animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83:4143-4146

[1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11,205-210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262,4429-4432 (1987); and Wagner et al., *Proc. Natl. Acad. Sci. USA* 87, 3410-3414 (1990). For review of gene marking and gene therapy protocols see Anderson et al., *Science* 256, 808-813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used diagnostically for tissue typing, wherein the PRO polypeptides of the present invention may be differentially expressed in one tissue as compared to another, preferably in a diseased tissue as compared to a normal tissue of the same tissue type. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicokinetics" In Toxicokinetics and New Drug Development, Yacobi et al., Eds., Pergamon Press, New York 1989, pp. 42-96.

When in vivo administration of a PRO polypeptide or agonist or antagonist thereof is employed, normal dosage amounts may vary from about 10 ng/kg to up to 100 mg/kg of mammal body weight or more per day, preferably about 1 μg/kg/day to 10 mg/kg/day, depending upon the route of administration. Guidance as to particular dosages and methods of delivery is provided in the literature; see, for example, U.S. Pat. Nos. 4,657,760; 5,206,344; or 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.*, 2:795-799 (1996); Yasuda, *Biomed. Ther.*, 27:1221-1223 (1993); Hora et al., *Bio/Technology*, 8:755-758 (1990); Cleland, "Design and Production of Single Immunization Vaccines Using Polylactide Polyglycolide Microsphere Systems," in *Vaccine Design: The Subunit and Adjuvant Approach*, Powell and Newman, eds, (Plenum Press: New York, 1995), pp. 439-462; WO 97/03692, WO 96/40072, WO 96/07399; and U.S. Pat. No. 5,654,010.

The sustained-release formulations of these proteins were developed using poly-lactic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1-41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature (London)*, 340:245-246 (1989); Chien et al., *Proc. Natl. Acad. Sci. USA*, 88:9578-9582 (1991)) as disclosed by Chevray and Nathans, *Proc. Natl. Acad. Sci. USA*, 89: 5789-5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.,* 6:3073 (1979); Cooney et al., *Science,* 241: 456 (1988); Dervan et al., *Science,* 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.,* 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology,* 4:469-471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Diagnostic and therapeutic uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51-63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature*, 321:522-525 (1986); Riechmann et al., *Nature*, 332:323-329 (1988); and Presta, *Curr. Op. Struct. Biol.*, 2:593-596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature*, 321:522-525 (1986); Riechmann et al., *Nature*, 332:323-327 (1988); Verhoeyen et al., *Science*, 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.*, 227:381 (1991); Marks et al., *J. Mol. Biol.*, 222:581 (1991)]. The techniques of Cole et al. and Boerner et al. are also available for the preparation of human monoclonal antibodies (Cole et al., *Monoclonal Antibodies and Cancer Therapy*, Alan R. Liss, p. 77 (1985) and Boerner et al., *J. Immunol.*, 147(1):86-95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779-783 (1992); Lonberg et al., *Nature* 368 856-859 (1994); Morrison. *Nature* 368, 812-13 (1994); Fishwild et al., *Nature Biotechnology* 14, 845-51 (1996); Neuberger, *Nature Biotechnology* 14, 826 (1996); Lonberg and Huszar, *Intern. Rev. Immunol.* 13 65-93 (1995).

The antibodies may also be affinity matured using known selection and/or mutagenesis methods as described above. Preferred affinity matured antibodies have an affinity which is five times, more preferably 10 times, even more preferably 20 or 30 times greater than the starting antibody (generally murine, humanized or human) from which the matured antibody is prepared.

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, *Nature*, 305:537-539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., *EMBO J.*, 10:3655-3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical link-age. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from *E. coli* and chemically coupled to form bispecific antibodies. Shalaby et al., *J. Exp. Med.* 175:217-225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al., *J. Immunol.* 148(5): 1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444-6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994). Antibodies with more than two valencies are contemplated. For example, trispecific antibodies can be prepared. Tutt et al., *J. Immunol.* 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.*, 176: 1191-1195 (1992) and Shopes, *J. Immunol.*, 148: 2918-2922 (1992). Homodimeric antibodies with enhanced anti-tumor activity may also be prepared using heterobifunctional cross-linkers as described in Wolff et al. *Cancer Research*, 53: 2560-2565 (1993). Alternatively, an antibody can be engineered that has dual Fc regions and may thereby have enhanced complement lysis and ADCC capabilities. See Stevenson et al., *Anti-Cancer Drug Design*, 3: 219-230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl Acad. Sci. USA*, 77:4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286-288 (1982) via a disulfide-interchange reaction. A chemotherapeutic agent (such as Doxorubicin) is optionally contained within the liposome. See Gabizon et al., *J. National Cancer Inst.*, 81(19): 1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA*, 90: 7889-7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences*, supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S-S bond formation through thio-disulfide interchange, stabilization may be achieved by modifying sulfhydryl residues, lyophilizing from acidic solutions, controlling moisture content, using appropriate additives, and developing specific polymer matrix compositions.

G. Uses for anti-PRO Antibodies

The anti-PRO antibodies of the invention have various utilities. For example, anti-PRO antibodies may be used in diagnostic assays for PRO, e.g., detecting its expression (and in some cases, differential expression) in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques*, CRC Press, Inc. (1987) pp. 147-158].

The antibodies used in the diagnostic assays can be labeled with a detectable moiety. The detectable moiety should be capable of producing, either directly or indirectly, a detectable signal. For example, the detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodarnine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature*, 144:945 (1962); David et al., *Biochemistry*, 13:1014 (1974); Pain et al., *J. Immunol. Meth.*, 40:219 (1981); and Nygren, *J. Histochem. and Cytochem.*, 30:407 (1982).

Anti-PRO antibodies also are useful for the affinity purification of PRO from recombinant cell culture or natural sources. In this process, the antibodies against PRO are immobilized on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST-2 (Altschul et al., *Methods in Enzymology* 266:460-480 (1996)) as a comparison of the ECD protein sequences to a 6 frame translation of the EST sequences. Those comparisons with a BLAST score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100-1000 bp in length. The probe sequences are typically 40-55 bp in length. In some cases, additional oligonucleotides are synthesized when the consensus sequence is greater than about 1-1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278-1280 (1991)) in the unique XhoI and NotI sites.

Example 2

Isolation of cDNA clones by Amylase Screening

1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI linkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500-1000 bp, linkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, MAL$^+$, SUC$^+$, GAL$^+$. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1p-4p) or the complex formation of these proteins may also be preferably employed in combination with the amylase-expressing yeast.

Transformation was performed based on the protocol outlined by Gietz et al., *Nucl. Acid. Res.*, 20: 1425 (1992). Transformed cells were then inoculated from agar into YEPD complex media broth (100 ml) and grown overnight at 30° C. The YEPD broth was prepared as described in Kaiser et al., *Methods in Yeast Genetics*, Cold Spring Harbor Press, Cold Spring Harbor, N.Y., p. 207 (1994). The overnight culture was then diluted to about $2 \times 10^6$ cells/ml (approx. $OD_{600}$=0.1) into fresh YEPD broth (500 ml) and regrown to $1 \times 10^7$ cells/m $OD_{600}$=0.4-0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM Li$_2$OOCCH$_3$), and resuspended into LiAc/TE (2.5 ml).

Transformation took place by mixing the prepared cells (100 µl) with freshly denatured single stranded salmon testes DNA (Lofstrand Labs, Gaithersburg, Md.) and transforming DNA (1 µg, vol.<10 µl) in microfuge tubes. The mixture was mixed briefly by vortexing, then 40% PEG/TE (600 µl, 40% polyethylene glycol-4000, 10 mM Tris-HCl, 1 mM EDTA, 100 mM Li$_2$OOCCH$_3$, pH 7.5) was added. This mixture was gently mixed and incubated at 30° C. while agitating for 30 minutes. The cells were then heat shocked at 42° C. for 15 minutes and the reaction vessel centrifuged in a microfuge at 12,000 rpm for 5-10 seconds, decanted and resuspended into TE (500 µl, 10 mM Tris-HCl, 1 mM EDTA pH 7.5) followed by recentrifugation. The cells were then diluted into TE (1 ml) and aliquots (200 µl) were spread onto the selective media previously prepared in 150 mm growth plates (VWR). Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics*, Cold Spring Harbor Press, Cold Spring Harbor, N.Y., p. 208-210 (1994). Transformants were grown at 30° C. for 2-3 days.

The detection of colonies secreting amylase was performed by including red starch in the selective growth media. Starch was coupled to the red dye (Reactive Red-120, Sigma) as per the procedure described by Biely et al., *Anal. Biochem.*, 172:176-179 (1988). The coupled starch was incorporated into the SCD-Ura agar plates at a final concentration of 0.15% (w/v), and was buffered with potassium phosphate to a pH of 7.0 (50-100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 µl) in a 96 well plate. At this time, the positive colonies were either frozen and stored for subsequent analysis or immediately amplified. An aliquot of cells (5 µl) was used as a template for the PCR reaction in a 25 µl volume containing: 0.5 µl Klentaq (Clontech, Palo Alto, Calif.); 4.0 µl 10 mM dNTP's (Perkin Elmer-Cetus); 2.5 µl Kentaq buffer (Clontech); 0.25 µl forward oligo 1; 0.25 µl reverse oligo 2; 12.5 µl distilled water. The sequence of the forward oligonucleotide 1 was:

5'-TGTAAAACGACGGCCAGT TAAATAGACCTGCAATTATAATCT-3' (SEQ ID NO:553)

The sequence of reverse oligonucleotide 2 was:

5'-CAGGAAACAGCTATGACC ACCTGCACACCTGCAAATCCATT-3' (SEQ ID NO:554)

PCR was then performed as follows:

| a. |  | Denature | 92° C., | 5 minutes |
|---|---|---|---|---|
| b. | 3 cycles of: | Denature | 92° C., | 30 seconds |
|  |  | Anneal | 59° C., | 30 seconds |
|  |  | Extend | 72° C., | 60 seconds |
| c. | 3 cycles of: | Denature | 92° C., | 30 seconds |
|  |  | Anneal | 57° C., | 30 seconds |
|  |  | Extend | 72° C., | 60 seconds |
| d. | 25 cycles of: | Denature | 92° C., | 30 seconds |
|  |  | Anneal | 55° C., | 30 seconds |
|  |  | Extend | 72° C., | 60 seconds |
| e. |  | Hold | 4° C. |  |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 µl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Using Signal Algorithm Analysis

Various polypeptide-encoding nucleic acid sequences were identified by applying a proprietary signal sequence finding algorithm developed by Genentech, Inc. (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

Example 4

Isolation of cDNA Clones Encoding Human PRO Polypeptides

Using the techniques described in Examples 1 to 3 above, numerous full-length cDNA clones were identified as encoding PRO polypeptides as disclosed herein. These cDNAs were then deposited under the terms of the Budapest Treaty with the American Type Culture Collection, 10801 University Blvd., Manassas, Va. 20110-2209, USA (ATCC) as shown in Table 7 below.

TABLE 7

| Material | ATCC Dep. No. | Deposit Date |
|---|---|---|
| DNA16438-1387 | 209771 | Apr. 14, 1998 |
| DNA19360-2552 | 203654 | Feb. 9, 1999 |
| DNA33455-1548 | PTA-127 | May 25, 1999 |
| DNA37155-2651 | PTA-429 | Jul. 27, 1999 |
| DNA38269-2654 | PTA-432 | Jul. 27, 1999 |
| DNA40619-1220 | 209525 | Dec. 10, 1997 |
| DNA44174-2513 | 203577 | Jan. 12, 1999 |
| DNA44675-2662 | PTA-430 | Jul. 27, 1999 |
| DNA45408-2615 | PTA-203 | Jun. 8, 1999 |

TABLE 7-continued

| Material | ATCC Dep. No. | Deposit Date |
| --- | --- | --- |
| DNA48606-1479 | 203040 | Jul. 1, 1998 |
| DNA52753-2656 | PTA-611 | Aug. 31, 1999 |
| DNA53915-1258 | 209593 | Jan. 21, 1998 |
| DNA53991-2553 | 203649 | Feb. 9, 1999 |
| DNA54009-2517 | 203574 | Jan. 12, 1999 |
| DNA56055-1643 | PTA-129 | May 25, 1999 |
| DNA57033-1403 | 209905 | May 27, 1998 |
| DNA57252-1453 | 203585 | Jan. 12, 1999 |
| DNA58799-1652 | 203665 | Feb. 9, 1999 |
| DNA59770-2652 | PTA-427 | Jul. 27, 1999 |
| DNA59774-2665 | PTA-615 | Aug. 31, 1999 |
| DNA60281-2518 | 203582 | Jan. 12, 1999 |
| DNA60736-2559 | 203838 | Mar. 9, 1999 |
| DNA61875-2653 | PTA-428 | Jul. 27, 1999 |
| DNA62312-2558 | 203836 | Mar. 9, 1999 |
| DNA62849-1604 | PTA-205 | Jun. 8, 1999 |
| DNA66307-2661 | PTA-431 | Jul. 27, 1999 |
| DNA66677-2535 | 203659 | Feb. 9, 1999 |
| DNA71235-1706 | 203584 | Jan. 12, 1999 |
| DNA71289-2547 | PTA-126 | May 25, 1999 |
| DNA73775-1707 | PTA-US | May 25, 1999 |
| DNA76385-1692 | 203664 | Feb. 9, 1999 |
| DNA76395-2527 | 203578 | Jan. 12, 1999 |
| DNA77622-2516 | 203554 | Dec. 22, 1998 |
| DNA77629-2573 | 203850 | Mar. 16, 1999 |
| DNA77645-2648 | PTA-45 | May 11, 1999 |
| DNA79302-2521 | 203545 | Dec. 22, 1998 |
| DNA79865-2519 | 203544 | Dec. 22, 1998 |
| DNA80135-2655 | PTA-234 | Jun. 15, 1999 |
| DNA80794-2568 | 203848 | Mar. 16, 1999 |
| DNA80796-2523 | 203555 | Dec. 22, 1998 |
| DNA80840-2605 | 203949 | Apr. 20, 1999 |
| DNA80899-2501 | 203539 | Dec. 15, 1998 |
| DNA81228-2580 | 203871 | Mar. 23, 1999 |
| DNA81761-2583 | 203862 | Mar. 23, 1999 |
| DNA82358-2738 | PTA-510 | Aug. 10, 1999 |
| DNA82364-2538 | 203603 | Jan. 20, 1999 |
| DNA82424-2566 | 203813 | Mar. 2, 1999 |
| DNA82430-2557 | 203812 | Mar. 2, 1999 |
| DNA83500-2506 | 203391 | Oct. 29, 1998 |
| DNA83509-2612 | 203965 | Apr. 27, 1999 |
| DNA83560-2569 | 203816 | Mar. 2, 1999 |
| DNA84139-2555 | 203814 | Mar. 2, 1999 |
| DNA84141-2556 | 203810 | Mar. 2, 1999 |
| DNA84142-2613 | PTA-22 | May 4, 1999 |
| DNA84318-2520 | 203580 | Jan. 12, 1999 |
| DNA84909-2590 | 203889 | Mar. 30, 1999 |
| DNA84912-2610 | 203964 | Apr. 27, 1999 |
| DNA84925-2514 | 203548 | Dec. 22, 1998 |
| DNA84928-2564 | 203817 | Mar. 2, 1999 |
| DNA84932-2657 | PTA-235 | Jun. 15, 1999 |
| DNA86592-2607 | 203968 | Apr. 27, 1999 |
| DNA86594-2587 | 203894 | Mar. 30, 1999 |
| DNA86647-2591 | 203893 | Mar. 30, 1999 |
| DNA87185-2563 | 203811 | Mar. 2, 1999 |
| DNA87656-2582 | 203867 | Mar. 23, 1999 |
| DNA87974-2609 | 203963 | Apr. 27, 1999 |
| DNA88001-2565 | 203815 | Mar. 2, 1999 |
| DNA88004-2575 | 203890 | Mar. 30, 1999 |
| DNA89220-2608 | PTA-130 | May 25, 1999 |
| DNA89947-2618 | 203970 | Apr. 27, 1999 |
| DNA90842-2574 | 203845 | Mar. 16, 1999 |
| DNA91775-2581 | 203861 | Mar. 23, 1999 |
| DNA91779-2571 | 203844 | Mar. 16, 1999 |
| DNA92217-2697 | PTA-513 | Aug. 10, 1999 |
| DNA92219-2541 | 203663 | Feb. 9, 1999 |
| DNA92223-2567 | 203851 | Mar. 16, 1999 |
| DNA92225-2603 | 203950 | Apr. 20, 1999 |
| DNA92232-2589 | 203895 | Mar. 30, 1999 |
| DNA92233-2599 | PTA-134 | May 25, 1999 |
| DNA92243-2549 | 203852 | Mar. 16, 1999 |
| DNA92253-2671 | PTA-258 | Jun. 22, 1999 |
| DNA92254-2672 | PTA-259 | Jun. 22, 1999 |
| DNA92255-2584 | 203866 | Mar. 23, 1999 |
| DNA92269-2570 | 203853 | Mar. 16, 1999 |
| DNA92288-2588 | 203892 | Mar. 30, 1999 |
| DNA92290-2550 | 203847 | Mar. 16, 1999 |
| DNA93012-2622 | PTA-21 | May 4, 1999 |
| DNA93020-2642 | PTA-121 | May 25, 1999 |
| DNA94830-2604 | 203951 | Apr. 20, 1999 |
| DNA94833-2579 | 203869 | Mar. 23, 1999 |
| DNA94838-2658 | PTA-232 | Jun. 15, 1999 |
| DNA94844-2686 | PTA-385 | Jul. 20, 1999 |
| DNA94854-2586 | 203864 | Mar. 23, 1999 |
| DNA96868-2677 | PTA-262 | Jun. 22, 1999 |
| DNA96871-2683 | PTA-381 | Jul. 20, 1999 |
| DNA96880-2624 | PTA-15 | May 4, 1999 |
| DNA96986-2660 | PTA-239 | Jun. 15, 1999 |
| DNA96988-2685 | PTA-384 | Jul. 20, 1999 |
| DNA96995-2709 | PTA-475 | Aug. 3, 1999 |
| DNA97004-2562 | 203854 | Mar. 16, 1999 |
| DNA97005-2687 | PTA-378 | Jul. 20, 1999 |
| DNA97009-2668 | PTA-257 | Jun. 22, 1999 |
| DNA97013-2667 | PTA-231 | Jun. 15, 1999 |
| DNA98380-2690 | PTA-388 | Jul. 20, 1999 |
| DNA98561-2696 | PTA-620 | Aug. 31, 1999 |
| DNA98575-2644 | PTA-118 | May 25, 1999 |
| DNA98593-2694 | PTA-477 | Aug. 3, 1999 |
| DNA98600-2703 | PTA-488 | Aug. 3, 1999 |
| DNA99391-2572 | 203849 | Mar. 16, 1999 |
| DNA99393-2560 | 203837 | Mar. 9, 1999 |
| DNA100276-2684 | PTA-380 | Jul. 20, 1999 |
| DNA100312-2645 | PTA-44 | May 11, 1999 |
| DNA100902-2646 | PTA-42 | May 11, 1999 |
| DNA102899-2679 | PTA-123 | May 25, 1999 |
| DNA104875-2720 | PTA-482 | Aug. 3, 1999 |
| DNA105680-2710 | PTA-483 | Aug. 3, 1999 |
| DNA105779-2708 | PTA-485 | Aug. 3, 1999 |
| DNA105794-2695 | PTA-480 | Aug. 3, 1999 |
| DNA105838-2702 | PTA-476 | Aug. 3, 1999 |
| DNA107698-2715 | PTA-472 | Aug. 3, 1999 |
| DNA107701-2711 | PTA-487 | Aug. 3, 1999 |
| DNA107781-2707 | PTA-484 | Aug. 3, 1999 |
| DNA108670-2744 | PTA-546 | Aug. 17, 1999 |
| DNA108688-2725 | PTA-515 | Aug. 10, 1999 |
| DNA108769-2765 | PTA-861 | Oct. 19, 1999 |
| DNA108935-2721 | PTA-518 | Aug. 10, 1999 |
| DNA110700-2716 | PTA-512 | Aug. 10, 1999 |
| DNA111750-2706 | PTA-489 | Aug. 3, 1999 |
| DNA123430-2755 | PTA-614 | Aug. 31, 1999 |
| DNA125154-2785 | PTA-957 | Nov. 16, 1999 |
| DNA142238-2768 | PTA-819 | Oct. 5, 1999 |
| DNA22779-1130 | 209280 | Sept. 18, 1997 |
| DNA26847-1395 | 209772 | Apr. 14, 1998 |
| DNA27864-1155 | 209375 | Oct. 16, 1997 |
| DNA27865-1091 | 209296 | Sept. 23, 1997 |
| DNA28497-1130 | 209279 | Sept. 18, 1997 |
| DNA29101-1122 | 209653 | Mar. 5, 1998 |
| DNA32286-1191 | 209385 | Oct. 16, 1997 |
| DNA32288-1132 | 209261 | Sept. 16, 1997 |
| DNA32290-1164 | 209384 | Oct. 16, 1997 |
| DNA32292-1131 | 209258 | Sept. 16, 1997 |
| DNA32298-1132 | 209257 | Sept. 16, 1997 |
| DNA33085-1110 | 209087 | May 30, 1997 |
| DNA33087-1158 | 209381 | Oct. 16, 1997 |
| DNA33089-1132 | 209262 | Sept. 16, 1997 |
| DNA33092-1202 | 209420 | Oct. 28, 1997 |
| DNA33094-1131 | 209256 | Sept. 16, 1997 |
| DNA33107-1135 | 209251 | Sept. 16, 1997 |
| DNA33221-1133 | 209263 | Sept. 16, 1997 |
| DNA33223-1136 | 209264 | Sept. 16, 1997 |
| DNA33460-1166 | 209376 | Oct. 16, 1997 |
| DNA33473-1176 | 209391 | Oct. 17, 1997 |
| DNA33785-1143 | 209417 | Oct. 28, 1997 |
| DNA33786-1132 | 209253 | Sept. 16, 1997 |
| DNA34353-1428 | 209855 | May 12, 1998 |
| DNA34392-1170 | 209526 | Dec. 10, 1997 |
| DNA34434-1139 | 209252 | Sept. 16, 1997 |
| DNA35558-1167 | 209374 | Oct. 16, 1997 |
| DNA35595-1228 | 209528 | Dec. 10, 1997 |
| DNA35638-1216 | 209265 | Sept. 16, 1997 |
| DNA35639-1172 | 209396 | Oct. 17, 1997 |
| DNA35663-1129 | 209201 | Aug. 18, 1997 |
| DNA35674-1142 | 209416 | Oct. 28, 1997 |

TABLE 7-continued

| Material | ATCC Dep. No. | Deposit Date |
|---|---|---|
| DNA35841-1173 | 209403 | Oct. 17, 1997 |
| DNA35916-1161 | 209419 | Oct. 28, 1997 |
| DNA35918-1174 | 209402 | Oct. 17, 1997 |
| DNA36350-1158 | 209378 | Oct. 16, 1997 |
| DNA37140-1234 | 209489 | Nov. 21, 1997 |
| DNA37150-1178 | 209401 | Oct. 17, 1997 |
| DNA38260-1180 | 209397 | Oct. 17, 1997 |
| DNA40021-1154 | 209389 | Oct. 17, 1997 |
| DNA40587-1231 | 209438 | Nov. 7, 1997 |
| DNA40592-1242 | 209492 | Nov. 21, 1997 |
| DNA40620-1183 | 209388 | Oct. 17, 1997 |
| DNA40628-1216 | 209432 | Nov. 7, 1997 |
| DNA40981-1234 | 209439 | Nov. 7, 1997 |
| DNA40982-1235 | 209433 | Nov. 7, 1997 |
| DNA41234-1242 | 209618 | Feb. 5, 1998 |
| DNA43046-1225 | 209484 | Nov. 21, 1997 |
| DNA43316-1237 | 209487 | Nov. 21, 1991 |
| DNA44167-1243 | 209434 | Nov. 7, 1997 |
| DNA44184-1319 | 209704 | Mar. 26, 1998 |
| DNA44194-1317 | 209808 | Apr. 28, 1998 |
| DNA44196-1353 | 209847 | May 6, 1998 |
| DNA45419-1252 | 209616 | Feb. 5, 1998 |
| DNA46777-1253 | 209619 | Feb. 5, 1998 |
| DNA47394-1572 | 203109 | Aug. 11, 1998 |
| DNA48331-1329 | 209715 | Mar. 31, 1998 |
| DNA48336-1309 | 209669 | Mar. 11, 1998 |
| DNA49142-1430 | 203002 | Jun. 23, 1998 |
| DNA49646-1327 | 209705 | Mar. 26, 1998 |
| DNA49821-1562 | 209981 | Jun. 16, 1998 |
| DNA49829-1346 | 209749 | Apr. 7, 1998 |
| DNA50921-1458 | 209859 | May 12, 1998 |
| DNA52187-1354 | 209845 | May 6, 1998 |
| DNA52196-1348 | 209748 | Apr. 7, 1998 |
| DNA52598-1518 | 203107 | Aug. 11, 1998 |
| DNA54228-1366 | 209801 | Apr. 23, 1998 |
| DNA56047-1456 | 209948 | Jun. 9, 1998 |
| DNA56112-1379 | 209883 | May 20, 1998 |
| DNA56113-1378 | 203049 | Jul. 1, 1998 |
| DNA56352-1358 | 209846 | May 6, 1998 |
| DNA56433-1406 | 209857 | May 12, 1998 |
| DNA56439-1376 | 209864 | May 14, 1998 |
| DNA57530-1375 | 209880 | May 20, 1998 |
| DNA57689-1385 | 209869 | May 14, 1998 |
| DNA57690-1374 | 209950 | Jun. 9, 1998 |
| DNA57693-1424 | 203008 | Jun. 23, 1998 |
| DNA57838-1337 | 203014 | Jun. 23, 1998 |
| DNA58721-1475 | 203110 | Aug. 11, 1998 |
| DNA59205-1421 | 203009 | Jun. 23, 1998 |
| DNA59215-1425 | 209961 | Jun. 9, 1998 |
| DNA59220-1514 | 209962 | Jun. 9, 1998 |
| DNA59294-1381 | 209866 | May 14, 1998 |
| DNA59488-1603 | 203157 | Aug. 25, 1998 |
| DNA59588-1571 | 203106 | Aug. 11, 1998 |
| DNA59606-1471 | 209945 | Jun. 9, 1998 |
| DNA59620-1463 | 209989 | Jun. 16, 1998 |
| DNA59767-1489 | 203108 | Aug. 11, 1998 |
| DNA59777-1480 | 203111 | Aug. 11, 1998 |
| DNA59814-1486 | 203359 | Oct. 20, 1998 |
| DNA59839-1461 | 209988 | Jun. 16,1998 |
| DNA59846-1503 | 209978 | Jun. 16, 1998 |
| DNA59847-1511 | 203098 | Aug. 4, 1998 |
| DNA60615-1483 | 209980 | Jun. 16, 1998 |
| DNA60621-1516 | 203091 | Aug. 4, 1998 |
| DNA60622-1525 | 203090 | Aug. 4, 1998 |
| DNA60627-1508 | 203092 | Aug. 4, 1998 |
| DNA60764-1533 | 203452 | Nov. 10, 1998 |
| DNA60775-1532 | 203173 | Sept. 1, 1998 |
| DNA61185-1646 | 203464 | Nov. 17, 1998 |
| DNA61873-1574 | 203132 | Aug. 18, 1998 |
| DNA62306-1570 | 203254 | Sept. 9, 1998 |
| DNA62808-1582 | 203358 | Oct. 20, 1998 |
| DNA62814-1521 | 203093 | Aug. 4, 1998 |
| DNA64885-1529 | 203457 | Nov. 3, 1998 |
| DNA64886-1601 | 203241 | Sept. 9, 1998 |
| DNA64888-1542 | 203249 | Sept. 9, 1998 |
| DNA64889-1541 | 203250 | Sept. 9, 1998 |
| DNA64890-1612 | 203131 | Aug. 18, 1998 |
| DNA64903-1553 | 203223 | Sept. 15, 1998 |
| DNA64905-1558 | 203233 | Sept. 15, 1998 |
| DNA65402-1540 | 203252 | Sept. 9, 1998 |
| DNA65405-1547 | 203476 | Nov. 17, 1998 |
| DNA65412-1523 | 203094 | Aug. 4, 1998 |
| DNA66309-1538 | 203235 | Sept. 15, 1998 |
| DNA66667-1596 | 203267 | Sept. 22, 1998 |
| DNA66675-1587 | 203282 | Sept. 22, 1998 |
| DNA68818-2536 | 203657 | Feb. 9, 1999 |
| DNA68864-1629 | 203276 | Sept. 22, 1998 |
| DNA68872-1620 | 203160 | Aug. 25, 1998 |
| DNA71159-1617 | 203135 | Aug. 18, 1998 |
| DNA73727-1673 | 203459 | Nov. 3, 1998 |
| DNA73739-1645 | 203270 | Sept. 22, 1998 |
| DNA76400-2528 | 203573 | Jan. 12, 1999 |
| DNA76510-2504 | 203477 | Nov. 17, 1998 |
| DNA76529-1666 | 203315 | Oct. 6, 1998 |
| DNA76538-1670 | 203313 | Oct. 6, 1998 |
| DNA77301-1708 | 203407 | Oct. 27, 1998 |
| DNA77624-2515 | 203553 | Dec. 22, 1998 |
| DNA79230-2525 | 203549 | Dec. 22, 1998 |
| DNA79862-2522 | 203550 | Dec. 22, 1998 |
| DNA80145-2594 | PTA-204 | Jun. 8, 1999 |
| DNA83500-2506 | 203391 | Oct. 29, 1998 |
| DNA84917-2597 | 203863 | Mar. 23, 1999 |
| DNA92218-2554 | 203834 | Mar. 9, 1999 |
| DNA96042-2682 | PTA-382 | Jul. 20, 1999 |

These deposits were made under the provisions of the Budapest Treaty on the International Recognition of the Deposit of Microorganisms for the Purpose of Patent Procedure and the Regulations there under (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent. assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

Example 5

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formaride, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 6

Expression of PRO in E. coli

This example illustrates preparation of an unglycosylated form of PRO by recombinant expression in E. coli.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STU codons, polyhis sequence, and enterokinase cleavage site), the PRO coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in E. coli in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an E. coli host based on strain 52 (W3110 fuhA(tonA) lon galE rpoHts(htpRts) clpP(lacIq).

Transformants are first grown in LB containing 50 mg/ml carbenicillin at 30° C. with shaking until an O.D.600 of 3-5 is reached. Cultures are then diluted 50-100 fold into CRAP media (prepared by mixing 3.57 g $(NH_4)_2SO_4$, 0.71 g sodium citrate.2H2O, 1.07 g KCl, 5.36 g Difco yeast extract, 5 Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

E. coli paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentrifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 7

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., *Cell* 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}S$-cysteine and 200 μCi/mil $^{35}S$-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.*, 127575 (1981). 293 cells are grown to maximal density in a spinner flask and 700 μg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}S$-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biolopy*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DRFR). DHFR expression permits selection for stable maintenance of the plasmid following transfection.

Twelve micrograms of the desired plasmid DNA is introduced into approximately 10 million CHO cells using commercially available transfection reagents Superfect® (Quiagen), Dosper® or Fugene® (Boehringer Mannheim). The cells are grown as described in Lucas et al., supra. Approximately $3 \times 10^{-7}$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 μm filtered PS20 with 5% 0.2 μm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and 2000 mL spinners are seeded with $3 \times 10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3L production spinner is seeded at $1.2 \times 10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 µm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 8

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 9

Expression of PRO in Baculovirus-Infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature* 362:175-179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 µm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Many of the PRO polypeptides disclosed herein were successfully expressed as described above.

Example 10

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 11

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2-3, or a high concentration of a chaotrope such as urea or thiocyanate ion), and PRO polypeptide is collected.

Example 12

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 13

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf, Hodgson, *Bio/Technology*, 9: 19-21 (1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry*. 31:7796-7801 (1992) or which act as inhibitors, agonists, or antagonists of native peptides as shown by Athauda et al., *J. Biochem.*, 113:742-746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 14

Identification of PRO Polypeptides that Stimulate TNF-α Release in Human Blood (Assay 128)

This assay shows that certain PRO polypeptides of the present invention act to stimulate the release of TNF-α in human blood. PRO polypeptides testing positive in this assay are useful for, among other things, research purposes where stimulation of the release of TNF-α would be desired and for the therapeutic treatment of conditions wherein enhanced TNF-α release would be beneficial. Specifically, 200 μl of human blood supplemented with 50 mM Hepes buffer (pH 7.2) is aliquoted per well in a 96 well test plate. To each well is then added 300 μl of either the test PRO polypeptide in 50 mM Hepes buffer (at various concentrations) or 50 mM Hepes buffer alone (negative control) and the plates are incubated at 37° C. for 6 hours. The samples are then centrifuged and 50 μl of plasma is collected from each well and tested for the presence of TNF-α by ELISA assay. A positive in the assay is a higher amount of TNT-α in the PRO polypeptide treated samples as compared to the negative control samples.

The following PRO polypeptides tested positive in this assay: PRO195, PRO202, PRO215, PRO221, PRO217, PRO222, PRO198, PRO245, PRO172, PRO265, PRO266, PRO344, PRO337, PRO322, PRO1286, PRO1279, PRO1338 and PRO1343.

Example 15

Detection of Polypeptides that Affect Glucose or FFA Uptake in Skeletal Muscle (Assay 106)

This assay is designed to determine whether PRO polypeptides show the ability to affect glucose or FFA uptake by skeletal muscle cells. PRO polypeptides testing positive in this assay would be expected to be useful for the therapeutic treatment of disorders where either the stimulation or inhibition of glucose uptake by skeletal muscle would be beneficial including, for example, diabetes or hyper- or hypo-insulinemia.

In a 96 well format, PRO polypeptides to be assayed are added to primary rat differentiated skeletal muscle, and allowed to incubate overnight. Then fresh media with the PRO polypeptide and +/−insulin are added to the wells. The sample media is then monitored to determine glucose and FFA uptake by the skeletal muscle cells. The insulin will stimulate glucose and FFA uptake by the skeletal muscle, and insulin in media without the PRO polypeptide is used as a positive control, and a limit for scoring. As the PRO polypeptide being tested may either stimulate or inhibit glucose and FFA uptake, results are scored as positive in the assay if greater than 1.5 times or less than 0.5 times the insulin control.

The following PRO polypeptides tested positive as being capable of affecting glucose and/or FFA uptake by skeletal muscle in this assay: PRO182, PRO366, PRO198, PRO172 and PRO719.

Example 16

Chondrocyte Re-differentiation Assay (Assay 110)

This assay shows that certain polypeptides of the invention act to induce redifferentiation of chondrocytes, therefore, are expected to be useful for the treatment of various bone and/or cartilage disorders such as, for example, sports injuries and arthritis. The assay is performed as follows. Porcine chondrocytes are isolated by overnight collagenase digestion of articulary cartilage of metacarpophalangeal-joints of 4-6 month old female pigs. The isolated cells are then seeded at 25,000 cells/cm$^2$ in HamF-12 containing 10% FBS and 4 µg/ml gentamycin. The culture media is changed every third day and the cells are then seeded in 96 well plates at 5,000 cells/well in 100 µl of the same media without serum and 100 µl of the test PRO polypeptide, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

The following polypeptide tested positive in this assay: PRO182, PRO366, PRO198 and PRO1868.

Example 17

Chondrocyte Proliferation Assay (Assay 111)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4-6 month old female pigs. The isolated cells are then seeded at 25,000 cells/cm$^2$ in Ham F-12 containing 10% FBS and 4 µg/ml gentamycin. The culture media is changed every third day and the cells are reseeded to 25,000 cells/cm$^2$ every five days. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 20 µl of Alamar blue is added to each well and the plates are incubated for an additional 3 hours at 37° C. The fluorescence is then measured in each well (Ex:530 nm; Em: 590 nm). The fluorescence of a plate containing 200 µl of the serum-free medium is measured to obtain the background. A positive result in the assay is obtained when the fluorescence of the PRO polypeptide treated sample is more like that of the positive control than the negative control.

The following PRO polypeptides tested positive in this assay: PRO202, PRO224, PRO172 and PRO1312.

Example 18

Detection of PRO Polypeptides that Affect Glucose or FFA Uptake by Primary Rat Adipocytes (Assay 94)

This assay is designed to determine whether PRO polypeptides show the ability to affect glucose or FFA uptake by adipocyte cells. PRO polypeptides testing positive in this assay would be expected to be useful for the therapeutic treatment of disorders where either the stimulation or inhibition of glucose uptake by adipocytes would be beneficial including, for example, obesity, diabetes or hyper- or hypo-insulinemia.

In a 96 well format, PRO polypeptides to be assayed are added to primary rat adipocytes, and allowed to incubate overnight Samples are taken at 4 and 16 hours and assayed for glycerol, glucose and FFA uptake. After the 16 hour incubation, insulin is added to the media and allowed to incubate for 4 hours. At this time, a sample is taken and glycerol, glucose and FFA uptake is measured. Media containing insulin without the PRO polypeptide is used as a positive reference control. As the PRO polypeptide being tested may either stimulate or inhibit glucose and FFA uptake, results are scored as positive in the assay if greater than 1.5 times or less than 0.5 times the insulin control.

The following PRO polypeptides tested positive as being capable of affecting glucose and/or FFA uptake in this assay: PRO202, PRO211, PRO344 and PRO1338.

Example 19

Gene Expression in Bovine Pericytes (Assay 105)

This assay is designed to identify PRO polypeptides which activate gene expression in pericytes. Such polypeptides would be expected to be useful as growth factors and/or for situations where the activation of gene expression is desired or beneficial. Bovine pericytes are plated on 60 mm culture dishes in growth media for 1 week. On day 1, various PRO polypeptides are diluted (1%) and incubated with the pericytes for 1, 4 and 24 hr. timepoints. The cells are harvested and the RNA isolated using TRI-Reagent following the included instructions. The RNA is then quantified by reading the 260/280 OD using a spectrophotometer. The gene expression analysis is done by TaqMan reactions using Perkin Elmer reagents and specially designed bovine probes and primers. Expression of the following genes is analyzed: GAPDH, beta-integrin, connective tissue growth factor (CTGF), ICAM-1, monocyte chemoattractant protein-1 (MCP-1), osteopontin, transforming growth factor-beta (TGF-beta), TGF-beta receptor, tissue inhibitor of metalloproteinase (TIMP), tissue factor (TF), VEGF-α, thrombospondin, VEGF-β, angiopoeitin-2, and collagenase. Replicates are then averaged and the SD determined. The gene expression levels are then normalized to GAPDH. These are then normalized to the expression levels obtained with a protein (PIN32) which does not significantly induce gene expression in bovine pericytes when compared to untreated controls. Any PRO polypeptide that gives a gene expression level 2-fold or higher over the PIN32 control is considered a positive hit.

The following PRO polypeptides tested positive in this assay: PRO366.

Example 20

Identification of PRO Polypeptides that Activate Pericytes (Assay 125)

This assay shows that certain polypeptides of the invention act to activate proliferation of pericyte cells and, therefore, are useful not only as diagnostic markers for particular types of pericyte-associated tumors but also for giving rise to antagonists which would be expected to be useful for the therapeutic treatment of pericyte-associated tumors. Such PRO polypeptides also would be expected to be useful as growth factors and/or for situations where the induction of cell proliferation is desired or beneficial. Activation of pericyte proliferation also correlates with the induction of angiogenesis and, as such, PRO polypeptides capable of inducing pericyte proliferation would be expected to be useful for the treatment of conditions where induced angiogenesis would be beneficial including, for example, wound healing, and the like. Specifically, on day 1, pericytes are received from VEC Technologies, and all but 5 ml media is removed from the flask. On day 2, the pericytes are trypsinized, washed, spun and plated on 96 well plates. On day 7, the media is removed and the pericytes are treated with 100 µl of either the specific PRO polypeptide or control treatments (positive control=DME+5%+/−PDGF@500 ng/µl; negative control=PIN32, a polypeptide determined to have no significant effect on pericyte proliferation). C-fos and GAPDH gene expression levels are then determined and the replicates are averaged and the SD is determined. The c-fos values are normalized to GAPDH and the results are expressed as fold increase over PIN32. Anything providing at least a 2-fold or higher response as compared to the negative control is considered positive for the assay.

The following polypeptides tested positive in this assay: PRO366.

Example 21

Ability of PRO Polypeptides to Stimulate the Release of Proteoglycans from Cartilage (Assay 97)

The ability of various PRO polypeptides to stimulate the release of proteoglycans from cartilage tissue was tested as follows.

The metacarphophalangea joint of 4-6 month old pigs was aseptically dissected, and articular cartilage was removed by free hand slicing being careful to avoid the underlying bone. The cartilage was minced and cultured in bulk for 24 hours in a humidified atmosphere of 95% air, 5% $CO_2$ in serum free (SF) media (DME/F12 1:1) with 0.1% BSA and 100 U/ml penicillin and 100 µg/ml streptomycin. After washing three times, approximately 100 mg of articular cartilage was aliquoted into micronics tubes and incubated for an additional 24 hours in the above SF media. PRO polypeptides were then added at 1% either alone or in combination with 18 ng/ml interleukin-1α, a known stimulator of proteoglycan release from cartilage tissue. The supernatant was then harvested and assayed for the amount of proteoglycans using the 1,9-dimethyl-methylene blue (DMB) colorimetric assay (Farndale and Buttle, *Biochem. Biophys. Acta* 883:173-177 (1985)). A positive result in this assay indicates that the test polypeptide will find use, for example, in the treatment of sports-related joint problems, articular cartilage defects, osteoarthritis or rheumatoid arthritis.

When various PRO polypeptides were tested in the above assay, the polypeptides demonstrated a marked ability to stimulate release of proteoglycans from cartilage tissue both basally and after stimulation with interleukin-1α and at 24 and 72 hours after treatment, thereby indicating that these PRO polypeptides are useful for stimulating proteoglycan release from cartilage tissue. As such, these PRO polypeptides are useful for the treatment of sports-related joint problems, articular cartilage defects, osteoarthritis or rheumatoid arthritis. The polypeptides testing positive in this assay are: PRO216.

Example 22

Proliferation of Rat Utricular Supporting Cells (Assay 54)

This assay shows that certain polypeptides of the invention act as potent mitogens for inner ear supporting cells which are auditory hair cell progenitors and, therefore, are useful for inducing the regeneration of auditory hair cells and treating hearing loss in mammals. The assay is performed as follows. Rat UEC-4 utricular epithelial cells are aliquoted into 96 well plates with a density of 3000 cells/well in 200 µl of serum-containing medium at 33° C. The cells are cultured overnight and are then switched to serum-free medium at 37° C. Various dilutions of PRO polypeptides (or nothing for a control) are then added to the cultures and the cells are incubated for 24 hours. After the 24 hour incubation, $^3$H-thymidine (1 µCi/well) is added and the cells are then cultured for an additional 24 hours. The cultures are then washed to remove unincorporated radiolabel, the cells harvested and Cpm per well determined. Cpm of at least 30% or greater in the PRO polypeptide treated cultures as compared to the control cultures is considered a positive in the assay.

The following polypeptides tested positive in this assay: PRO172.

Example 23

Stimulatory Activity in Mixed Lymphocyte Reaction (MLR) Assay (Assay 24)

This example shows that certain polypeptides of the invention are active as a stimulator of the proliferation of stimulated T-lymphocytes. Compounds which stimulate proliferation of lymphocytes are useful therapeutically where enhancement of an immune response is beneficial. A therapeutic agent may take the form of antagonists of the polypeptide of the invention, for example, murine-human chimeric, humanized or human antibodies against the polypeptide.

The basic protocol for this assay is described in Current Protocols in Immunology, unit 3.12; edited by J E Coligan, A M Kruisbeek, D H Marglies, E M Shevach, W Strober, National Institutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37°

C., 5% $CO_2$) and then washed and resuspended to $3\times10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:

100:1 of test sample diluted to 1% or to 0.1%,
50:1 of irradiated stimulator cells, and
50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicimin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1\times10^7$ cells/ml of assay media. The assay is then conducted as described above.

Positive increases over control are considered positive with increases of greater than or equal to 180% being preferred. However, any value greater than control indicates a stimulatory effect for the test protein.

The following PRO polypeptides tested positive in this assay: PRO344.

Example 24

Pericyte c-Fos Induction (Assay 93)

This assay shows that certain polypeptides of the invention act to induce the expression of c-fos in pericyte cells and, therefore, are useful not only as diagnostic markers for particular types of pericyte-associated tumors but also for giving rise to antagonists which would be expected to be useful for the therapeutic treatment of pericyte-associated tumors. Induction of c-fos expression in pericytes is also indicative of the induction of angiogenesis and, as such, PRO polypeptides capable of inducing the expression of c-fos would be expected to be useful for the treatment of conditions where induced angiogenesis would be beneficial including, for example, wound healing, and the like. Specifically, on day 1, pericytes are received from VEC Technologies and all but 5 ml of media is removed from flask. On day 2, the pericytes are trypsinized, washed, spun and then plated onto 96 well plates. On day 7, the media is removed and the pericytes are treated with 100 µl of PRO polypeptide test samples and controls (positive control=DME+5% serum+/−PDGF at 500 ng/ml; negative control=protein 32). Replicates are averaged and SD/CV are determined. Fold increase over Protein 32 (buffer control) value indicated by chemiluminescence units (RLU) luminometer reading verses frequency is plotted on a histogram. Two-fold above Protein 32 value is considered positive for the assay. ASY Matrix: Growth media=low glucose DMEM=20% FBS+1× pen strep+1× fungizone. Assay Media=low glucose DMEM+5% FBS.

The following polypeptides tested positive in this assay: PRO301, PRO619, PRO1066 and PRO1265.

Example 25

Cytokine Release Assay (Assay 120)

This assay is designed to determine whether PRO polypeptides of the present invention are capable of inducing the release of cytokines from peripheral blood mononuclear cells (PBMCs). PRO polypeptides capable of inducing the release of cytokines from PBMCs are useful from the treatment of conditions which would benefit from enhanced cytokine release and will be readily evident to those of ordinary skill in the art. Specifically, $1\times10^6$ cells/ml of peripheral blood mononuclear cells (PBMC) are cultured with 1% of a PRO polypeptide for 3 days in complete RPMI media. The supernatant is then harvested and tested for increased concentrations of various cytokines by ELISA as compared to a human IgG treated control. A positive in the 2-0 assay is a 10-fold or greater increase in cytokine concentration in the PRO polypeptide treated sample as compared to the human IgG treated control.

The following polypeptides tested positive in this assay: PRO526 and PRO1343.

Example 26

Inhibition of A-Peptide Binding to Factor VIIA (Assay 118)

This assay is designed to identify PRO polypeptides which are capable of inhibiting the binding of A-peptide to factor VIIA, thereby affecting the blood coagulation cascade. PRO polypeptides testing positive in this assay are expected to be useful for the treatment of conditions where alteration of the blood coagulation cascade would be beneficial including, for example, stroke, heart attack and various coagulation disorders. These PRO polypeptides are also useful for the identification of agonist and antagonist molecules which would also be useful for treatment of those conditions.

Specifically, 384 well plates are coated with soluble factor VIIA and are incubated overnight at 4° C. The wells are then decanted and are blocked by the addition of 0.5% BSA for 1 hour. The wells are then washed and 20 µl of biotinylated A-peptide and either various concentration of the PRO polypeptide (test) or nothing (negative control) are added to each well The plates are then incubated for 1 hour at room temperature. The wells are again washed and then 40 µl of streptavidin-europium is added to each well. The plates are then incubated for 30 minutes at room temperature and then washed. 40 µl of a fluorescence enhancement solution is then added to each well, the plates incubated for 5 minutes at room temperature and each well is then read on Wallac Victor reader under europium delayed fluorescence settings. Percent inhibition of binding of the A-peptide to the factor VIIA is then determined (as compared to the negative control), wherein a positive in the assay is a percent inhibition of 30% or greater.

The following PRO polypeptides tested positive in this assay: PRO182.

Example 27

Inhibition of Adipocyte Differentiation Assay
(Assay 66)

This assay is designed to identify PRO polypeptides which are capable of inhibiting insulin-induced differentiation of adipocytes. PRO polypeptides testing positive in this assay would be expected to be useful for the treatment of conditions associated with obesity, diabetes, etc.

Specifically, 3T3-L1 cells are seeded into the wells of 96 well plates at $6 \times 10^4$ cells/well and allowed to grow to confluency for 7 days. At day 7, the cells are treated with various concentrations of the PRO polypeptide (or nothing for the negative control) in the presence of 1 µg/ml insulin, $0.25 \times 10^{-6}$ M dexamethasone and 0.5 mM IBMX. The samples are then incubated at 37° C. in 7% $CO_2$ for 2 days. After the incubation, the media is removed by aspiration and the cells are washed with PBS and re-exposed to the PRO polypeptide (or nothing for the negative control) and 1 µg/ml insulin. After 5 days, the media is removed and replaced with fresh PRO polypeptide (or nothing for the negative control) and insulin. After 5 days, the cells are lysed and the cell lysate is assayed using Sigma's Triglyceride [INT] kit (Sigma procedure #336). A positive in the assay is 20% greater inhibition of adipocyte differentiation in the PRO polypeptide treated samples as compared to the negative control.

The following PRO polypeptides tested positive in this assay: PRO185 and PRO198.

Example 28

HUVEC Stimulation by PRO Polypeptides
(Assay 131)

This assay is designed to identify PRO polypeptides which are capable of stimulating the proliferation of HUVEC cells. PRO polypeptides testing positive in this assay would be expected to be useful for inducing angiogenesis for the treatment of conditions where angiogenesis would be beneficial including, for example, wound healing, and the like. Antagonists of these PRO polypeptides would be expected to be useful for inhibiting angiogenesis for the treatment of, for example, tumors, and the like.

Specifically, COSTAR® flat bottom black plates are treated with fibronectin for 20 minutes and then washed twice with PBS. HWVEC cells are then plated at 2000 cells/well in an appropriate growth medium. The plates are then incubated overnight and then the PRO polypeptide (1% final concentration), nothing (negative control) or IL1β (3.3 ng/ml final concentration; positive control) is added. The plates are again incubated overnight, stained with ICAM1-Cy5 and read on FMAT. A positive in the assay is a 2-fold or greater increase in fluorescence as compared to the positive control.

The following PRO polypeptides tested positive in this assay: PRO222.

Example 29

Promotion of Chondrocyte Redifferentiation
(Assay 129)

This assay is designed to determine whether PRO polypeptides of the present invention show the ability to induce the proliferation and/or redifferentiation of chondrocytes in culture. PRO polypeptides testing positive. in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4-6 month old female pigs. The isolated cells are then seeded at 25,000 cells/$cm^2$ in Ham F-12 containing 10% FBS and 4 µg/ml gentamycin. The culture media is changed every third day. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 22 µl of containing 100 µg/ml Hoechst 33342 and 50 µg/ml 5-CFDA is added to each well and incubated for an additional 10 minutes at 37° C. A picture of the green fluorescence is taken for each well and the differentiation state of the chondrocytes is calculated by morphometric analysis. A positive result in the assay is obtained when the >50% of the PRO polypeptide treated cells are differentiated (compared to the background obtained by the negative control).

The following PRO polypeptides tested positive in this assay: PRO301.

Example 30

Microarray Analysis to Detect Overexpression of PRO Polypeptides in Cancerous Tumors Nucleic acid microarrays, often containing thousands of gene sequences, are useful for identifying differentially expressed genes in diseased tissues as compared to their normal counterparts. Using nucleic acid microarrays, test and control mRNA samples from test and control tissue samples are reverse transcribed and labeled to generate cDNA probes. The cDNA probes are then hybridized to an array of nucleic acids immobilized on a solid support. The array is configured such that the sequence and position of each member of the array is known. For example, a selection of genes known to be expressed in certain disease states may be arrayed on a solid support. Hybridization of a labeled probe with a particular array member indicates that the sample from which the probe was derived expresses that gene. If the hybridization signal of a probe from a test (disease tissue) sample is greater than hybridization signal of a probe from a control (normal tissue) sample, the gene or genes overexpressed in the disease tissue are identified. The implication of this result is that an overexpressed protein in a diseased tissue is useful not only as a diagnostic marker for the presence of the disease condition, but also as a therapeutic target for treatment of the disease condition.

The methodology of hybridization of nucleic acids and microarray technology is well known in the art. In the present example, the specific preparation of nucleic acids for hybridization and probes, slides, and hybridization conditions are all detailed in U.S. Provisional Patent Application Ser. No. 60/193,767, filed on Mar. 31, 2000 and which is herein incorporated by reference.

In the present example, cancerous tumors derived from various human tissues were studied for PRO polypeptide-encoding gene expression relative to non-cancerous human tissue in an attempt to identify those PRO polypeptides which are overexpressed in cancerous tumors. Two sets of experimental data were generated. In one set, cancerous human colon tumor tissue and matched non-cancerous human colon tumor tissue from the same patient ("matched colon control") were obtained and analyzed for PRO polypeptide expression using the above described microarray technology. In the second set of data, cancerous human tumor tissue from any of a variety of different human tumors was obtained and compared to a "universal" epithelial control sample which was prepared by pooling non-cancerous human tissues of epithelial origin, including liver, kidney, and lung. mRNA isolated from the pooled tissues represents a mixture of expressed gene products from these different tissues. Microarray hybridization experiments using the pooled control samples generated a linear plot in a 2-color analysis. The slope of the line generated in a 2-color analysis was then used to normalize the ratios of (test:control detection) within each experiment. The normalized ratios from various experiments were then compared and used to identify clustering of gene expression. Thus, the pooled "universal control" sample not only allowed effective relative gene expression determinations in a simple 2-sample comparison, it also allowed multi-sample comparisons across several experiments.

In the present experiments, nucleic acid probes derived from the herein described PRO polypeptide-encoding nucleic acid sequences were used in the creation of the microarray and RNA from the tumor tissues listed above were used for the hybridization thereto. A value based upon the normalized ratio:experimental ratio was designated as a "cutoff ratio". Only values that were above this cutoff ratio were determined to be significant. Table 8 below shows the results of these experiments, demonstrating that various PRO polypeptides of the present invention are significantly overexpressed in various human tumor tissues as compared to a non-cancerous human tissue control. As described above, these data demonstrate that the PRO polypeptides of the present invention are useful not only as diagnostic markers for the presence of one or more cancerous tumors, but also serve as therapeutic targets for the treatment of those tumors.

TABLE 8

| Molecule | is overexpressed in: | as compared to: |
|---|---|---|
| PRO177 | breast tumor | universal normal control |
| PRO177 | liver tumor | universal normal control |
| PRO177 | lung tumor | universal normal control |
| PRO3574 | breast tumor | universal normal control |
| PRO3574 | colon tumor | matched normal colon control |
| PRO1280 | breast tumor | universal normal control |
| PRO1280 | lung tumor | universal normal control |
| PRO4984 | lung tumor | universal normal control |
| PRO4988 | colon tumor | universal normal control |
| PRO4988 | lung tumor | universal normal control |
| PRO305 | lung tumor | universal normal control |
| PRO305 | colon tumor | universal normal control |
| PRO1866 | prostate tumor | universal normal control |
| PRO1866 | lung tumor | universal normal control |
| PRO1866 | colon tumor | universal normal control |
| PRO4996 | breast tumor | universal normal control |
| PRO4996 | lung tumor | universal normal control |
| PRO4406 | lung tumor | universal normal control |
| PRO4406 | colon tumor | universal normal control |
| PRO1120 | colon tumor | universal normal control |
| PRO1120 | breast tumor | universal normal control |
| PRO1120 | rectal tumor | universal normal control |
| PRO4990 | lung tumor | universal normal control |
| PRO738 | cervical tumor | universal normal control |
| PRO738 | lung tumor | universal normal control |
| PRO738 | breast tumor | universal normal control |
| PRO3577 | lung tumor | universal normal control |
| PRO1879 | breast tumor | universal normal control |

TABLE 8-continued

| Molecule | is overexpressed in: | as compared to: |
|---|---|---|
| PRO1879 | lung tumor | universal normal control |
| PRO1879 | colon tumor | universal normal control |
| PRO1471 | lung tumor | universal normal control |
| PRO1076 | prostate tumor | universal normal control |
| PRO1483 | lung tumor | universal normal control |
| PRO4985 | rectal tumor | universal normal control |
| PRO4985 | colon tumor | universal normal control |
| PRO4985 | breast tumor | universal normal control |
| PRO4985 | lung tumor | universal normal control |
| PRO5000 | lung tumor | universal normal control |
| PRO1881 | liver tumor | universal normal control |
| PRO1881 | lung tumor | universal normal control |
| PRO1881 | breast tumor | universal normal control |
| PRO4314 | lung tumor | universal normal control |
| PRO4314 | breast tumor | universal normal control |
| PRO4987 | lung tumor | universal normal control |
| PRO4313 | lung tumor | universal normal control |
| PRO4313 | breast tumor | universal normal control |
| PRO4799 | colon tumor | universal normal control |
| PRO4995 | liver tumor | universal normal control |
| PRO4995 | colon tumor | universal normal control |
| PRO4995 | colon tumor | matched normal colon control |
| PRO1341 | prostate tumor | universal normal control |
| PRO1341 | lung tumor | universal normal control |
| PRO1341 | colon tumor | universal normal control |
| PRO1341 | colon tumor | matched normal colon control |
| PRO1777 | lung tumor | universal normal control |
| PRO1777 | colon tumor | matched normal colon control |
| PRO3580 | lung tumor | universal normal control |
| PRO3580 | prostate tumor | universal normal control |
| PRO1779 | lung tumor | universal normal control |
| PRO1779 | colon tumor | universal normal control |
| PRO1779 | cervical tumor | universal normal control |
| PRO1754 | breast tumor | universal normal control |
| PRO1754 | lung tumor | universal normal control |
| PRO1906 | breast tumor | universal normal control |
| PRO1906 | colon tumor | universal normal control |
| PRO1906 | prostate tumor | universal normal control |
| PRO1870 | breast tumor | universal normal control |
| PRO4329 | lung tumor | universal normal control |
| PRO4979 | colon tumor | universal normal control |
| PRO1885 | rectal tumor | universal normal control |
| PRO1885 | colon tumor | universal normal control |
| PRO1885 | colon tumor | matched normal colon control |
| PRO1882 | prostate tumor | universal normal control |
| PRO1882 | lung tumor | universal normal control |
| PRO1882 | colon tumor | universal normal control |
| PRO1882 | breast tumor | universal normal control |
| PRO1882 | cervical tumor | universal normal control |
| PRO4989 | rectal tumor | universal normal control |
| PRO4989 | breast tumor | universal normal control |
| PRO4989 | colon tumor | matched normal colon control |
| PRO4989 | colon tumor | universal normal control |
| PRO4323 | lung tumor | universal normal control |
| PRO4323 | liver tumor | universal normal control |
| PRO1886 | breast tumor | universal normal control |
| PRO1886 | lung tumor | universal normal control |
| PRO1886 | rectal tumor | universal normal control |
| PRO4395 | colon tumor | universal normal control |
| PRO4395 | prostate tumor | universal normal control |
| PRO4395 | lung tumor | universal normal control |
| PRO4395 | cervical tumor | universal normal control |
| PRO1782 | colon tumor | universal normal control |
| PRO1782 | lung tumor | universal normal control |
| PRO4388 | lung tumor | universal normal control |
| PRO4341 | breast tumor | universal normal control |
| PRO4341 | lung tumor | universal normal control |
| PRO3438 | lung tumor | universal normal control |
| PRO4321 | breast tumor | universal normal control |
| PRO4321 | lung tumor | universal normal control |
| PRO4321 | colon tumor | universal normal control |
| PRO4304 | breast tumor | universal normal control |
| PRO4304 | lung tumor | universal normal control |
| PRO4403 | colon tumor | universal normal control |
| PRO4403 | breast tumor | universal normal control |
| PRO4403 | lung tumor | universal normal control |
| PRO4324 | lung tumor | universal normal control |

TABLE 8-continued

| Molecule | is overexpressed in: | as compared to: |
|---|---|---|
| PRO4324 | breast tumor | universal normal control |
| PRO4303 | cervical tumor | universal normal control |
| PRO4303 | lung tumor | universal normal control |
| PRO4303 | breast tumor | universal normal control |
| PRO4303 | colon tumor | universal normal control |
| PRO4303 | prostate tumor | universal normal control |
| PRO4305 | breast tumor | universal normal control |
| PRO4305 | lung tumor | universal normal control |
| PRO4305 | colon tumor | universal normal control |
| PRO4305 | liver tumor | universal normal control |
| PRO4404 | lung tumor | universal normal control |
| PRO4404 | breast tumor | universal normal control |
| PRO4404 | rectal tumor | universal normal control |
| PRO1884 | lung tumor | universal normal control |
| PRO4349 | colon tumor | universal normal control |
| PRO4349 | lung tumor | universal normal control |
| PRO4401 | colon tumor | universal normal control |
| PRO4401 | lung tumor | universal normal control |
| PRO1867 | lung tumor | universal normal control |
| PRO1867 | liver tumor | universal normal control |
| PRO4319 | breast tumor | universal normal control |
| PRO4319 | lung tumor | universal normal control |
| PRO4991 | lung tumor | universal normal control |
| PRO4991 | colon tumor | universal normal control |
| PRO4398 | lung tumor | universal normal control |
| PRO4346 | lung tumor | universal normal control |
| PRO4350 | colon tumor | universal normal control |
| PRO4350 | prostate tumor | universal normal control |
| PRO4350 | lung tumor | universal normal control |
| PRO4318 | prostate tumor | universal normal control |
| PRO4318 | lung tumor | universal normal control |
| PRO4340 | breast tumor | universal normal control |
| PRO4340 | lung tumor | universal normal control |
| PRO4400 | breast tumor | universal normal control |
| PRO4400 | lung tumor | universal normal control |
| PRO4320 | lung tumor | universal normal control |
| PRO4409 | lung tumor | universal normal control |
| PRO4409 | cervical tumor | universal normal control |
| PRO4409 | colon tumor | universal normal control |
| PRO4399 | lung tumor | universal normal control |
| PRO4399 | breast tumor | universal normal control |
| PRO4418 | lung tumor | universal normal control |
| PRO4418 | breast tumor | universal normal control |
| PRO4330 | cervical tumor | universal normal control |
| PRO4330 | colon tumor | matched normal colon control |
| PRO4339 | breast tumor | universal normal control |
| PRO4339 | colon tumor | universal normal control |
| PRO4326 | lung tumor | universal normal control |
| PRO4326 | colon tumor | universal normal control |
| PRO6014 | breast tumor | universal normal control |
| PRO3446 | colon tumor | universal normal control |
| PRO3446 | lung tumor | universal normal control |
| PRO4322 | lung tumor | universal normal control |
| PRO4322 | rectal tumor | universal normal control |
| PRO4322 | colon tumor | matched normal colon control |
| PRO4381 | breast tumor | universal normal control |
| PRO4381 | lung tumor | universal normal control |
| PRO4381 | colon tumor | universal normal control |
| PRO4348 | lung tumor | universal normal control |
| PRO4348 | prostate tumor | universal normal control |
| PRO4371 | breast tumor | universal normal control |
| PRO3742 | colon tumor | universal normal control |
| PRO3742 | lung tumor | universal normal control |
| PRO5773 | lung tumor | universal normal control |
| PRO5773 | colon tumor | universal normal control |
| PRO5773 | prostate tumor | universal normal control |
| PRO5774 | colon tumor | universal normal control |
| PRO4343 | colon tumor | universal normal control |
| PRO4325 | lung tumor | universal normal control |
| PRO4347 | lung tumor | universal normal control |
| PRO4347 | colon tumor | universal normal control |
| PRO4347 | rectal tumor | universal normal control |
| PRO3743 | colon tumor | universal normal control |
| PRO3743 | lung tumor | universal normal control |
| PRO3743 | prostate tumor | universal normal control |
| PRO4426 | colon tumor | universal normal control |
| PRO4500 | colon tumor | universal normal control |

TABLE 8-continued

| Molecule | is overexpressed in: | as compared to: |
|---|---|---|
| PRO4389 | breast tumor | universal normal control |
| PRO4389 | lung tumor | universal normal control |
| PRO4337 | colon tumor | universal normal control |
| PRO4337 | breast tumor | universal normal control |
| PRO4337 | lung tumor | universal normal control |
| PRO4992 | lung tumor | universal normal control |
| PRO5996 | lung tumor | universal normal control |
| PRO4345 | lung tumor | universal normal control |
| PRO4345 | colon tumor | universal normal control |
| PRO5780 | lung tumor | universal normal control |
| PRO5780 | breast tumor | universal normal control |
| PRO5992 | lung tumor | universal normal control |
| PRO5992 | colon tumor | universal normal control |
| PRO5992 | breast tumor | universal normal control |
| PRO4428 | prostate tumor | universal normal control |
| PRO4994 | lung tumor | universal normal control |
| PRO5995 | lung tumor | universal normal control |
| PRO5995 | colon tumor | universal normal control |
| PRO6094 | lung tumor | universal normal control |
| PRO6094 | colon tumor | universal normal control |
| PRO4317 | lung tumor | universal normal control |
| PRO4317 | colon tumor | universal normal control |
| PRO4317 | liver tumor | universal normal control |
| PRO4317 | colon tumor | matched normal colon control |
| PRO5997 | colon tumor | universal normal control |
| PRO5997 | lung tumor | universal normal control |
| PRO5005 | lung tumor | universal normal control |
| PRO5005 | colon tumor | universal normal control |
| PRO5004 | colon tumor | universal normal control |
| PRO6001 | breast tumor | universal normal control |
| PRO6013 | colon tumor | universal normal control |
| PRO4502 | lung tumor | universal normal control |
| PRO4502 | colon tumor | universal normal control |
| PRO6007 | breast tumor | universal normal control |
| PRO6028 | breast tumor | universal normal control |
| PRO6028 | colon tumor | universal normal control |
| PRO4327 | prostate tumor | universal normal control |
| PRO4315 | colon tumor | universal normal control |
| PRO5993 | lung tumor | universal normal control |
| PRO5993 | colon tumor | universal normal control |
| PRO4503 | colon tumor | universal normal control |
| PRO4976 | lung tumor | universal normal control |
| PRO5798 | lung tumor | universal normal control |
| PRO5798 | colon tumor | universal normal control |
| PRO6242 | colon tumor | universal normal control |
| PRO6242 | colon tumor | matched normal colon control |
| PRO6242 | breast tumor | universal normal control |
| PRO6242 | liver tumor | universal normal control |
| PRO6242 | rectal tumor | universal normal control |
| PRO6095 | breast tumor | universal normal control |
| PRO6095 | lung tumor | universal normal control |
| PRO6093 | colon tumor | universal normal control |
| PRO6093 | breast tumor | universal normal control |
| PRO6093 | lung tumor | universal normal control |
| PRO6093 | colon tumor | matched normal colon control |
| PRO6012 | colon tumor | universal normal control |
| PRO6027 | lung tumor | universal normal control |
| PRO6027 | colon tumor | universal normal control |
| PRO6027 | rectal tumor | universal normal control |
| PRO6181 | prostate tumor | universal normal control |
| PRO6181 | lung tumor | universal normal control |
| PRO6181 | colon tumor | universal normal control |
| PRO6097 | colon tumor | universal normal control |
| PRO6097 | lung tumor | universal normal control |
| PRO6090 | lung tumor | universal normal control |
| PRO7171 | lung tumor | universal normal control |
| PRO7171 | colon tumor | universal normal control |
| PRO7171 | breast tumor | universal normal control |
| PRO6258 | prostate tumor | universal normal control |
| PRO6258 | breast tumor | universal normal control |
| PRO6258 | cervical tumor | universal normal control |
| PRO6258 | liver tumor | universal normal control |
| PRO6258 | colon tumor | universal normal control |
| PRO9820 | prostate tumor | universal normal control |
| PRO6243 | lung tumor | universal normal control |
| PRO6182 | lung tumor | universal normal control |
| PRO6079 | lung tumor | universal normal control |

TABLE 8-continued

| Molecule | is overexpressed in: | as compared to: |
|---|---|---|
| PRO6079 | colon tumor | universal normal control |
| PRO6079 | breast tumor | universal normal control |
| PRO6079 | prostate tumor | universal normal control |
| PRO7434 | lung tumor | universal normal control |
| PRO9865 | colon tumor | universal normal control |
| PRO9828 | colon tumor | universal normal control |
| PRO196 | colon tumor | universal normal control |
| PRO196 | lung tumor | universal normal control |
| PRO196 | breast tumor | universal normal control |
| PRO197 | colon tumor | universal normal control |
| PRO197 | lung tumor | universal normal control |
| PRO197 | breast tumor | universal normal control |
| PRO195 | colon tumor | universal normal control |
| PRO195 | lung tumor | universal normal control |
| PRO195 | breast tumor | universal normal control |
| PRO187 | lung tumor | universal normal control |
| PRO187 | liver tumor | universal normal control |
| PRO182 | colon tumor | universal normal control |
| PRO182 | lung tumor | universal normal control |
| PRO182 | breast tumor | universal normal control |
| PRO188 | rectal tumor | universal normal control |
| PRO183 | colon tumor | universal normal control |
| PRO183 | lung tumor | universal normal control |
| PRO183 | breast tumor | universal normal control |
| PRO183 | rectal tumor | universal normal control |
| PRO184 | lung tumor | universal normal control |
| PRO184 | breast tumor | universal normal control |
| PRO185 | lung tumor | universal normal control |
| PRO200 | colon tumor | universal normal control |
| PRO200 | lung tumor | universal normal control |
| PRO200 | breast tumor | universal normal control |
| PRO200 | rectal tumor | universal normal control |
| PRO202 | colon tumor | universal normal control |
| PRO202 | lung tumor | universal normal control |
| PRO202 | breast tumor | universal normal control |
| PRO202 | rectal tumor | universal normal control |
| PRO202 | liver tumor | universal normal control |
| PRO214 | colon tumor | universal normal control |
| PRO214 | lung tumor | universal normal control |
| PRO215 | colon tumor | universal normal control |
| PRO215 | lung tumor | universal normal control |
| PRO215 | breast tumor | universal normal control |
| PRO219 | colon tumor | universal normal control |
| PRO219 | lung tumor | universal normal control |
| PRO219 | breast tumor | universal normal control |
| PRO219 | liver tumor | universal normal control |
| PRO211 | lung tumor | universal normal control |
| PRO211 | breast tumor | universal normal control |
| PRO220 | colon tumor | universal normal control |
| PRO220 | lung tumor | universal normal control |
| PRO220 | breast tumor | universal normal control |
| PRO366 | colon tumor | universal normal control |
| PRO366 | lung tumor | universal normal control |
| PRO366 | breast tumor | universal normal control |
| PRO216 | lung tumor | universal normal control |
| PRO221 | colon tumor | universal normal control |
| PRO221 | lung tumor | universal normal control |
| PRO221 | breast tumor | universal normal control |
| PRO228 | lung tumor | universal normal control |
| PRO228 | breast tumor | universal normal control |
| PRO217 | lung tumor | universal normal control |
| PRO217 | breast tumor | universal normal control |
| PRO222 | colon tumor | universal normal control |
| PRO222 | lung tumor | universal normal control |
| PRO222 | breast tumor | universal normal control |
| PRO224 | colon tumor | universal normal control |
| PRO224 | lung tumor | universal normal control |
| PRO224 | breast tumor | universal normal control |
| PRO224 | prostate tumor | universal normal control |
| PRO224 | rectal tumor | universal normal control |
| PRO230 | colon tumor | universal normal control |
| PRO230 | lung tumor | universal normal control |
| PRO230 | breast tumor | universal normal control |
| PRO230 | prostate tumor | universal normal control |
| PRO198 | colon tumor | universal normal control |
| PRO198 | lung tumor | universal normal control |
| PRO198 | breast tumor | universal normal control |
| PRO198 | liver tumor | universal normal control |
| PRO226 | lung tumor | universal normal control |
| PRO226 | breast tumor | universal normal control |
| PRO261 | lung tumor | universal normal control |
| PRO242 | colon tumor | universal normal control |
| PRO242 | lung tumor | universal normal control |
| PRO242 | breast tumor | universal normal control |
| PRO227 | colon tumor | universal normal control |
| PRO227 | lung tumor | universal normal control |
| PRO237 | colon tumor | universal normal control |
| PRO237 | lung tumor | universal normal control |
| PRO237 | breast tumor | universal normal control |
| PRO237 | prostate tumor | universal normal control |
| PRO241 | colon tumor | universal normal control |
| PRO241 | lung tumor | universal normal control |
| PRO241 | breast tumor | universal normal control |
| PRO231 | colon tumor | universal normal control |
| PRO231 | lung tumor | universal normal control |
| PRO231 | breast tumor | universal normal control |
| PRO231 | rectal tumor | universal normal control |
| PRO235 | colon tumor | universal normal control |
| PRO235 | lung tumor | universal normal control |
| PRO235 | breast tumor | universal normal control |
| PRO235 | liver tumor | universal normal control |
| PRO323 | lung tumor | universal normal control |
| PRO323 | breast tumor | universal normal control |
| PRO323 | rectal tumor | universal normal control |
| PRO245 | colon tumor | universal normal control |
| PRO245 | lung tumor | universal normal control |
| PRO245 | breast tumor | universal normal control |
| PRO245 | cervical tumor | universal normal control |
| PRO245 | liver tumor | universal normal control |
| PRO246 | colon tumor | universal normal control |
| PRO246 | lung tumor | universal normal control |
| PRO246 | breast tumor | universal normal control |
| PRO288 | lung tumor | universal normal control |
| PRO288 | breast tumor | universal normal control |
| PRO248 | lung tumor | universal normal control |
| PRO248 | rectal tumor | universal normal control |
| PRO257 | colon tumor | universal normal control |
| PRO257 | lung tumor | universal normal control |
| PRO257 | prostate tumor | universal normal control |
| PRO172 | colon tumor | universal normal control |
| PRO172 | lung tumor | universal normal control |
| PRO172 | breast tumor | universal normal control |
| PRO258 | colon tumor | universal normal control |
| PRO258 | lung tumor | universal normal control |
| PRO258 | breast tumor | universal normal control |
| PRO265 | lung tumor | universal normal control |
| PRO265 | breast tumor | universal normal control |
| PRO265 | rectal tumor | universal normal control |
| PRO326 | colon tumor | universal normal control |
| PRO326 | lung tumor | universal normal control |
| PRO326 | breast tumor | universal normal control |
| PRO326 | liver tumor | universal normal control |
| PRO266 | colon tumor | universal normal control |
| PRO266 | lung tumor | universal normal control |
| PRO266 | breast tumor | universal normal control |
| PRO269 | lung tumor | universal normal control |
| PRO269 | rectal tumor | universal normal control |
| PRO285 | colon tumor | universal normal control |
| PRO285 | lung tumor | universal normal control |
| PRO285 | breast tumor | universal normal control |
| PRO328 | colon tumor | universal normal control |
| PRO328 | lung tumor | universal normal control |
| PRO328 | breast tumor | universal normal control |
| PRO344 | breast tumor | universal normal control |
| PRO272 | lung tumor | universal normal control |
| PRO301 | colon tumor | universal normal control |
| PRO301 | lung tumor | universal normal control |
| PRO301 | breast tumor | universal normal control |
| PRO331 | colon tumor | universal normal control |
| PRO331 | lung tumor | universal normal control |
| PRO331 | breast tumor | universal normal control |
| PRO332 | colon tumor | universal normal control |
| PRO332 | lung tumor | universal normal control |
| PRO332 | breast tumor | universal normal control |

TABLE 8-continued

| Molecule | is overexpressed in: | as compared to: |
|---|---|---|
| PRO353 | colon tumor | universal normal control |
| PRO353 | lung tumor | universal normal control |
| PRO353 | breast tumor | universal normal control |
| PRO310 | colon tumor | universal normal control |
| PRO310 | lung tumor | universal normal control |
| PRO310 | breast tumor | universal normal control |
| PRO310 | rectal tumor | universal normal control |
| PRO337 | colon tumor | universal normal control |
| PRO337 | lung tumor | universal normal control |
| PRO337 | breast tumor | universal normal control |
| PRO346 | lung tumor | universal normal control |
| PRO350 | lung tumor | universal normal control |
| PRO350 | breast tumor | universal normal control |
| PRO526 | colon tumor | universal normal control |
| PRO526 | lung tumor | universal normal control |
| PRO526 | breast tumor | universal normal control |
| PRO381 | colon tumor | universal nonnal control |
| PRO381 | lung tumor | universal normal control |
| PRO381 | breast tumor | universal normal control |
| PRO381 | prostate tumor | universal normal control |
| PRO846 | colon tumor | universal normal control |
| PRO846 | lung tumor | universal normal control |
| PRO363 | colon tumor | universal normal control |
| PRO363 | lung tumor | universal normal control |
| PRO365 | lung tumor | universal normal control |
| PRO365 | breast tumor | universal normal control |
| PRO1310 | breast tumor | universal normal control |
| PRO731 | colon tumor | universal normal control |
| PRO731 | lung tumor | universal normal control |
| PRO731 | breast tumor | universal normal control |
| PRO322 | colon tumor | universal normal control |
| PRO322 | lung tumor | universal normal control |
| PRO322 | breast tumor | universal normal control |
| PRO322 | rectal tumor | universal normal control |
| PRO322 | liver tumor | universal normal control |
| PRO536 | lung tumor | universal normal control |
| PRO536 | breast tumor | universal normal control |
| PRO536 | liver tumor | universal normal control |
| PRO719 | colon tumor | universal normal control |
| PRO719 | lung tumor | universal normal control |
| PRO719 | breast tumor | universal normal control |
| PRO619 | colon tumor | universal normal control |
| PRO619 | lung tumor | universal normal control |
| PRO619 | breast tumor | universal normal control |
| PRO771 | colon tumor | universal normal control |
| PRO771 | lung tumor | universal normal control |
| PRO771 | breast tumor | universal normal control |
| PRO1083 | colon tumor | universal normal control |
| PRO1083 | lung tumor | universal normal control |
| PRO1083 | breast tumor | universal normal control |
| PRO1083 | prostate tumor | universal normal control |
| PRO862 | colon tumor | universal normal control |
| PRO862 | lung tumor | universal normal control |
| PRO862 | breast tumor | universal normal control |
| PRO733 | colon tumor | universal normal control |
| PRO733 | lung tumor | universal normal control |
| PRO733 | breast tumor | universal normal control |
| PRO733 | liver tumor | universal normal control |
| PRO1188 | lung tumor | universal normal control |
| PRO1188 | breast tumor | universal normal control |
| PRO1188 | rectal tumor | universal normal control |
| PRO770 | lung tumor | universal normal control |
| PRO770 | breast tumor | universal normal control |
| PRO1080 | colon tumor | universal normal control |
| PRO1080 | lung tumor | universal normal control |
| PRO1080 | breast tumor | universal normal control |
| PRO1017 | colon tumor | universal normal control |
| PRO1017 | lung tumor | universal normal control |
| PRO1017 | breast tumor | universal normal control |
| PRO1016 | colon tumor | universal normal control |
| PRO1016 | lung tumor | universal normal control |
| PRO1016 | breast tumor | universal normal control |
| PRO1016 | rectal tumor | universal normal control |
| PRO792 | lung tumor | universal normal control |
| PRO938 | colon tumor | universal normal control |
| PRO938 | lung tumor | universal normal control |
| PRO938 | breast tumor | universal normal control |
| PRO1012 | colon tumor | universal normal control |
| PRO1012 | lung tumor | universal normal control |
| PRO1012 | rectal tumor | universal normal control |
| PRO1012 | liver tumor | universal normal control |
| PRO1008 | lung tumor | universal normal control |
| PRO1075 | colon tumor | universal normal control |
| PRO1075 | lung tumor | universal normal control |
| PRO1007 | colon tumor | universal normal control |
| PRO1007 | lung tumor | universal normal control |
| PRO1007 | breast tumor | universal normal control |
| PRO1007 | rectal tumor | universal normal control |
| PRO1056 | colon tumor | universal normal control |
| PRO1056 | lung tumor | universal normal control |
| PRO1056 | breast tumor | universal normal control |
| PRO791 | colon tumor | universal normal control |
| PRO791 | lung tumor | universal normal control |
| PRO791 | breast tumor | universal normal control |
| PRO791 | rectal tumor | universal normal control |
| PRO1111 | colon tumor | universal normal control |
| PRO1111 | lung tumor | universal normal control |
| PRO1111 | breast tumor | universal normal control |
| PRO812 | lung tumor | universal normal control |
| PRO812 | breast tumor | universal normal control |
| PRO812 | rectal tumor | universal normal control |
| PRO1066 | lung tumor | universal normal control |
| PRO1185 | colon tumor | universal normal control |
| PRO1185 | lung tumor | universal normal control |
| PRO1185 | breast tumor | universal normal control |
| PRO1031 | lung tumor | universal normal control |
| PRO1360 | lung tumor | universal normal control |
| PRO1360 | breast tumor | universal normal control |
| PRO1309 | lung tumor | universal normal control |
| PRO1309 | breast tumor | universal normal control |
| PRO1107 | lung tumor | universal normal control |
| PRO1107 | breast tumor | universal normal control |
| PRO836 | colon tumor | universal normal control |
| PRO836 | lung tumor | universal normal control |
| PRO1132 | lung tumor | universal normal control |
| PRO1132 | breast tumor | universal normal control |
| PRO1131 | colon tumor | universal normal control |
| PRO1131 | lung tumor | universal normal control |
| PRO1131 | breast tumor | universal normal control |
| PRO1131 | liver tumor | universal normal control |
| PRO1130 | colon tumor | universal normal control |
| PRO1130 | lung tumor | universal normal control |
| PRO1130 | breast tumor | universal normal control |
| PRO844 | colon tumor | universal normal control |
| PRO844 | lung tumor | universal normal control |
| PRO844 | breast tumor | universal normal control |
| PRO844 | rectal tumor | universal normal control |
| PRO1154 | colon tumor | universal normal control |
| PRO1154 | lung tumor | universal normal control |
| PRO1154 | rectal tumor | universal normal control |
| PRO1154 | liver tumor | universal normal control |
| PRO1181 | lung tumor | universal normal control |
| PRO1181 | breast tumor | universal normal control |
| PRO1126 | colon tumor | universal normal control |
| PRO1126 | lung tumor | universal normal control |
| PRO1126 | breast tumor | universal normal control |
| PRO1126 | adrenal tumor | universal normal control |
| PRO1186 | colon tumor | universal normal control |
| PRO1186 | lung tumor | universal normal control |
| PRO1186 | breast tumor | universal normal control |
| PRO1186 | liver tumor | universal normal control |
| PRO1198 | colon tumor | universal normal control |
| PRO1198 | lung tumor | universal normal control |
| PRO1159 | lung tumor | universal normal control |
| PRO1159 | breast tumor | universal normal control |
| PRO1159 | liver tumor | universal normal control |
| PRO1265 | colon tumor | universal normal control |
| PRO1265 | breast tumor | universal normal control |
| PRO1250 | colon tumor | universal normal control |
| PRO1250 | lung tumor | universal normal control |
| PRO1250 | breast tumor | universal normal control |
| PRO1475 | colon tumor | universal normal control |
| PRO1475 | breast tumor | universal normal control |
| PRO1312 | colon tumor | universal normal control |

TABLE 8-continued

| Molecule | is overexpressed in: | as compared to: |
|---|---|---|
| PRO1312 | lung tumor | universal normal control |
| PRO1312 | breast tumor | universal normal control |
| PRO1308 | colon tumor | universal normal control |
| PRO1308 | lung tumor | universal normal control |
| PRO1308 | liver tumor | universal normal control |
| PRO1326 | colon tumor | universal normal control |
| PRO1325 | lung tumor | universal normal control |
| PRO1326 | breast tumor | universal normal control |
| PRO1192 | colon tumor | universal normal control |
| PRO1192 | lung tumor | universal normal control |
| PRO1192 | breast tumor | universal normal control |
| PRO1246 | colon tumor | universal normal control |
| PRO1246 | lung tumor | universal normal control |
| PRO1246 | breast tumor | universal normal control |
| PRO1246 | prostate tumor | universal normal control |
| PRO1356 | colon tumor | universal normal control |
| PRO1356 | lung tumor | universal normal control |
| PRO1356 | breast tumor | universal normal control |
| PRO1275 | lung tumor | universal normal control |
| PRO1275 | breast tumor | universal normal control |
| PRO1274 | lung tumor | universal normal control |
| PRO1358 | colon tumor | universal normal control |
| PRO1358 | lung tumor | universal normal control |
| PRO1358 | prostate tumor | universal normal control |
| PRO1286 | colon tumor | universal normal control |
| PRO1286 | lung tumor | universal normal control |
| PRO1286 | prostate tumor | universal normal control |
| PRO1286 | rectal tumor | universal normal control |
| PRO1294 | colon tumor | universal normal control |
| PRO1294 | lung tumor | universal normal control |
| PRO1294 | breast tumor | universal normal control |
| PRO1294 | rectal tumor | universal normal control |
| PRO1273 | lung tumor | universal normal control |
| PRO1273 | rectal tumor | universal normal control |
| PRO1279 | colon tumor | universal normal control |
| PRO1279 | lung tumor | universal normal control |
| PRO1195 | lung tumor | universal normal control |
| PRO1195 | breast tumor | universal normal control |
| PRO1271 | lung tumor | universal normal control |
| PRO1271 | breast tumor | universal normal control |
| PRO1271 | liver tumor | universal normal control |
| PRO1338 | colon tumor | universal normal control |
| PRO1338 | lung tumor | universal normal control |
| PRO1338 | breast tumor | universal normal control |
| PRO1343 | colon tumor | universal normal control |
| PRO1343 | lung tumor | universal normal control |
| PRO1343 | breast tumor | universal normal control |
| PRO1343 | rectal tumor | universal normal control |
| PRO1434 | lung tumor | universal normal control |
| PRO1418 | lung tumor | universal normal control |
| PRO1418 | liver tmnor | universal normal control |
| PRO1387 | colon tumor | universal normal control |
| PRO1387 | lung tumor | universal normal control |
| PRO1387 | prostate tumor | universal normal control |
| PRO1387 | rectal tumor | universal normal control |
| PRO1384 | colon tumor | universal normal control |
| PRO1384 | lung tumor | universal normal control |
| PRO1565 | colon tumor | universal normal control |
| PRO1565 | lung tumor | universal normal control |
| PRO1565 | prostate tumor | universal normal control |
| PRO1474 | colon tumor | universal normal control |
| PRO1474 | lung tumor | universal normal control |
| PRO1474 | breast tumor | universal normal control |
| PRO1474 | rectal tumor | universal normal control |
| PRO1917 | colon tumor | universal normal control |
| PRO1917 | lung tumor | universal normal control |
| PRO1917 | breast tumor | universal normal control |
| PRO1787 | colon tumor | universal normal control |
| PRO1787 | lung tumor | universal normal control |
| PRO1787 | breast tumor | universal normal control |
| PRO1556 | lung tumor | universal normal control |
| PRO1556 | breast tumor | universal normal control |
| PRO1561 | colon tumor | universal normal control |
| PRO1561 | lung tumor | universal normal control |
| PRO1561 | rectal tumor | universal normal control |
| PRO1693 | colon tumor | universal normal control |
| PRO1693 | lung tumor | universal normal control |
| PRO1693 | breast tumor | universal normal control |
| PRO1868 | lung tumor | universal normal control |
| PRO1868 | breast tumor | universal normal control |
| PRO1890 | colon tumor | universal normal control |
| PRO1890 | lung tumor | universal normal control |
| PRO1890 | breast tumor | universal normal control |
| PRO1890 | prostate tumor | universal normal control |
| PRO1887 | colon tumor | universal normal control |
| PRO1887 | breast tumor | universal normal control |
| PRO4353 | lung tumor | universal normal control |
| PRO4353 | breast tumor | universal normal control |
| PRO1801 | colon tumor | universal normal control |
| PRO1801 | lung tumor | universal normal control |
| PRO4357 | lung tumor | universal normal control |
| PRO4357 | breast tumor | universal normal control |
| PRO4302 | colon tumor | universal normal control |
| PRO4302 | lung tumor | universal normal control |
| PRO4302 | breast tumor | universal normal control |
| PRO4302 | prostate tumor | universal normal control |
| PRO5990 | colon tumor | universal normal control |
| PRO5990 | lung tumor | universal normal control |
| PRO5990 | breast tumor | universal normal control |

Example 31

Identification of Receptor/Ligand Interactions

In this assay, various PRO polypeptides are tested for ability to bind to a panel of potential receptor or ligand molecules for the purpose of identifying receptor/ligand interactions. The identification of a ligand for a known receptor, a receptor for a known ligand or a novel receptor/ligand pair is useful for a variety of indications including, for example, targeting bioactive molecules (linked to the ligand or receptor) to a cell known to express the receptor or ligand, use of the receptor or ligand as a reagent to detect the presence of the ligand or receptor in a composition suspected of containing the same, wherein the composition may comprise cells suspected of expressing the ligand or receptor, modulating the growth of or another biological or immunological activity of a cell known to express or respond to the receptor or ligand, modulating the immune response of cells or toward cells that express the receptor or ligand, allowing the preparation of agonists, antagonists and/or antibodies directed against the receptor or ligand which will modulate the growth of or a biological or immunological activity of a cell expressing the receptor or ligand, and various other indications which will be readily apparent to the ordinarily skilled artisan.

The assay is performed as follows. A PRO polypeptide of the present invention suspected of being a ligand for a receptor is expressed as a fusion protein containing the Fc domain of human IgG (an immunoadhesin). Receptor-ligand binding is detected by allowing interaction of the immunoadhesin polypeptide with cells (e.g. Cos cells) expressing candidate PRO polypeptide receptors and visualization of bound immunoadhesin with fluorescent reagents directed toward the Fc fusion domain and examination by microscope. Cells expressing candidate receptors are produced by transient transfection, in parallel, of defined subsets of a library of cDNA expression vectors encoding PRO polypeptides that may function as receptor molecules. Cells are then incubated for 1 hour in the presence of the PRO polypeptide immunoadhesin being tested for possible receptor binding. The cells are then washed and fixed with paraformaldehyde. The cells are then incubated with fluorescent conjugated antibody directed against the Fc portion of the PRO polypeptide immunoadhesin (e.g. FITC conjugated goat anti-human-Fc antibody). The cells are then washed again and examined by microscope. A positive interaction is judged by the presence of fluorescent labeling of cells transfected with cDNA encoding a particular PRO polypeptide receptor or pool of receptors and an absence of similar fluorescent labeling of similarly prepared cells that have been transfected with other cDNA or pools of cDNA. If a defined pool of cDNA expression vectors is judged to be positive for interaction with a PRO polypeptide immunoadhesin, the individual cDNA species that comprise the pool are tested individually (the pool is "broken down") to determine the specific cDNA that encodes a receptor able to interact with the PRO polypeptide immunoadhesin.

In another embodiment of this assay, an epitope-tagged potential ligand PRO polypeptide (e.g. 8 histidine "His" tag) is allowed to interact with a panel of potential receptor PRO polypeptide molecules that have been expressed as fusions with the Fc domain of human IgG (immunoadhesins). Following a 1 hour co-incubation with the epitope tagged PRO polypeptide, the candidate receptors are each immunoprecipitated with protein A beads and the beads are washed. Potential ligand interaction is determined by western blot analysis of the immunoprecipitated complexes with antibody directed towards the epitope tag. An interaction is judged to occur if a band of the anticipated molecular weight of the epitope tagged protein is observed in the western blot analysis with a candidate receptor, but is not observed to occur with the other members of the panel of potential receptors.

Using these assays, the following receptor/ligand interactions have been herein identified:

(1) PRO1801 binds to PRO1114 and PRO4978.
(2) PRO100 binds to PRO1114.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (550 sequences)

SEQ ID NO: 1 - DNA, 1264 bp, Homo Sapien
gttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtacaaaaaaaaaaaaaaa

SEQ ID NO: 2 - protein, 188 aa, Homo Sapien
MSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 3 - DNA, 1395 bp, Homo Sapien
agccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactaaaaaaaaaaaaaaa

SEQ ID NO: 4 - protein, 215 aa, Homo Sapien
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFESTSSVRFANL

SEQ ID NO: 5 - DNA, 1760 bp, Homo Sapien
cccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaactctgaacctatcctcggagctctgccctcccgtcctggaacgtctttctgccctgaggagagggtagtcagcatctccaattttcagcagctcaagaaccttggcccccacaggacttcgcagatgtcacattgcccctcagtcccctgaatgcccttcggacccaaccccaattccccaagcccctgaccccctagctgccggggttcccactcccagtgccacaaccccctcacctcccctggcagcccctcagcgagcctgaggcccagcacccgctggctccccagcacatggtcccctcccatgggctgttgcccagggaaccggggcgcggtgggaacgagctgctggcctcggcatgtttcaataaagttgctgtgctgggag

SEQ ID NO: 6 - protein, 433 aa, Homo Sapien
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQL

SEQ ID NO: 7 - DNA, 1730 bp, Homo Sapien
cgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacaatttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttaaaaaaaaaaaaaaaaaaa

SEQ ID NO: 8 - protein, 166 aa, Homo Sapien
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 9 - DNA, 2276 bp, Homo Sapien
cggacgcgtgggcgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtcaaaaaaaaaaaaaaaaaaaaaaaaaaaaaaaaaaaaaaaaaaaaaaaaaaaaaaaaaa

SEQ ID NO: 10 - protein, 594 aa, Homo Sapien
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVTQADASGEAETEDAEGAEQAVQGG

SEQ ID NO: 11 - DNA, 1547 bp, Homo Sapien
ggtaggcgcgcccagacctgagacgggttgggactgggctgcgtcacgcgcgggctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcatggaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatata

SEQ ID NO: 12 - protein, 334 aa, Homo Sapien
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 13 - DNA, 2762 bp, Homo Sapien
ggcggcgtcatgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcatttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaacctcttgcttaaaatgcgttttattttgataagatacttcaaatagcctccaaaagtgtagatccaatcacttaaataaacctgtatgtatatgcaaaaaaaaaaaaaaaaaaaaaaa

SEQ ID NO: 14 - protein, 541 aa, Homo Sapien
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 15 - DNA, 2956 bp, Homo Sapien
gtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtaa

SEQ ID NO: 16 - protein, 691 aa, Homo Sapien
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 17 - DNA, 1528 bp, Homo Sapien
gcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaaaaaaaaa

SEQ ID NO: 18 - protein, 347 aa, Homo Sapien
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 19 - DNA, 3906 bp, Homo Sapien
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaa

SEQ ID NO: 20 - protein, 867 aa, Homo Sapien
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 21 - DNA, 1041 bp, Homo Sapien
gggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaaggtataggtcaaccaatgttattttcaaactatctgaaatgaatttattttaacattgacacatgtaagggtcaatttttcatatttggaagctcaaacattccttgaatgaaaatattttgaaatgccttaactgtctaagattttactttaaatattggaacttttaaagaagcattatagggaacagccttttttcatgcacttatggtaaataactataaaaacaaatgaattacaataaatttataattcatgacaactgaatttgggaaaggtaatagttaagtgtttttccactaaattacttttt

SEQ ID NO: 22 - protein, 151 aa, Homo Sapien [sequence omitted]

SEQ ID NO: 23 - DNA, 1121 bp, Homo Sapien
gaggcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaa

SEQ ID NO: 24 - protein, 285 aa, Homo Sapien
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 25 - DNA, 2698 bp, Homo Sapien
ctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcgtctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggctgatcgtcgaagggcatctaaccaaagcggtagaagaaacaaagctttcaaaaggtttgttttctgtttttctatgttttttgacagttcttttggataatgaaggttagtgtatattttcaaggttatagtattttaaccatcagtttacttcttatagctcacaaaatagcaagccagtaacagtatcagataatatataaaataatcagacttctgttttaagaagggtatcgtaactggaatgtgtctttttaagtggatgtatatttatggttttttgaatgttagtacttgatataggtttctttaggtattaaagatttgttgcaatctctgtcattcccagcattaatttcagctttgatctcaaattttaatcaaacacaatgtaagtcgtttgtgatacaacttaagtgaaacatgcttgcacttctattttgggggttacagtacctttaaaatctcttatgatgtttaatatttccttaatttttggcatctcagtttgatttaaacaaaattaatgacttttgtgaatgtagaatcttcttatattttatgagtagtccagtaattgcccaaagtagtttattgtgttaattctgttacagttgtcagagaagaaaagtgagttttaaagcaccatattgtcaagtcacttttatacatagggaaattaggcaaataaatttggtggcatgtgtttatcatagtagaactttcattagactataccagtataaaatttaaaactagattcacagtccttttggccaattaaaacattgagttacaaaagtttgagatacttaattttagtacattctattttattaaagtaactggattcatttgacttttttaaccatgtaagaggatggtgttatttcaaatatctcgtggtttccattctgaattttgtgcacggcagatgccatatttggggaaaaaatgcatagaatatgcatcattaatattgttttggcaaacaggcattgagtttcagaacagtgaactatttttagtacatatggcaatttttttcaccttattaaagtgagatgagaacagaccttaaaatagcttttacctcaccatccaaatacctattcagattagttggttgaatagccagcactttgaagtagagccttagg

SEQ ID NO: 26 - protein, 296 aa, Homo Sapien
MEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLADRRRASNQSGRRNKAFKRFVFCFSMFFDSSFG

SEQ ID NO: 27 - DNA, 2700 bp, Homo Sapien
gaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttctactgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaaaaaa

SEQ ID NO: 28 - protein, 765 aa, Homo Sapien [sequence omitted]

SEQ ID NO: 29 - DNA, 1701 bp, Homo Sapien
ggcacgagggcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggtttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcat

SEQ ID NO: 30 - protein, 223 aa, Homo Sapien
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 31 - DNA, 2056 bp, Homo Sapien
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtaaaaaaaaaaaaaaaa

SEQ ID NO: 32 - protein, 311 aa, Homo Sapien
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 33 - DNA, 2531 bp, Homo Sapien
gagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcgaaaccatggcagaggaatacatctctcacacatactcacaaacacacacacaagcacttgcacatacatacaaacacatgcaaacatacctacacacacacactctcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagtta

SEQ ID NO: 34 - protein, 328 aa, Homo Sapien
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 35 - DNA, 3371 bp, Homo Sapien
gtcggaaccccctcaggccaccctcgggagtcctggggtccagaggggtgtccctgtaccccttgcacacaggaccctcactctgcagggataagccagctgcgcctgcagcctagggtgccaaggaggctgctgattgtggcccacagcctcatctgaacgccaggagaccaggataccgaggcaccggatcccctctctgtgccctggggagccccagtgctgcccagtcaccccagggctgaggtctgcgtccctagtggtgcaaggcctggtaggaccacggggcagggaatgtgagcgccatccgagctcacggtgtcctgagtcgcggcttcgtgactttggcaggggcctccggaccagtgaccccagtcaaacccagagggtcttgggcggcagcgacgaaggaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgacgccaccaccctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctatgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcaggaaaaaggatgactatatggagtcagggaccaagaaggataactccatcctggaaatccgcggccctgggctgcagatgctgcccatcaacccgtaccgcgccaaagaggagtacgtggtccacactatcttcccctccaacggcagcagcctctgcaaggccacacacaccattggctacggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctccgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggtttttttttttcccccctgaactggaaggatactacctgtacaacatctgtggacacctcatgctctgttcaaggccatcacaaaggaaccgccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgattaaaaaaaaaaacaaacttttttttcctaggctgaagccctcttcagttccatgcaccacgctccgtagaagccccggcggaagccgtagctttccctgccacctggaggtgcatctgtctgcctgtctatccctgtcgcggtgtctctaagtacagatgggtagatagagccacatgcacggtccttaccgttcttcttgggtcagttcttaccatttcctgaacaatagaattgtgaaagtgttaaaaa

SEQ ID NO: 36 - protein, 674 aa, Homo Sapien
MVVAHPTATATTTPTATVTATVVMTTATMDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSRKKDDYMESGTKKDNSILEIRGPGLQMLPINPYRAKEEYVVHTIFPSNGSSLCKATHTIGYGTTRGYRDGGIPDIDYSYT

SEQ ID NO: 37 - DNA, 3501 bp, Homo Sapien
  unsure 2762, 2778: unknown base
ggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggagaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgtctgaccccgtcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagangactacttacgtgtgncgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactttttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacatttttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 38 - protein, 1013 aa, Homo Sapien
  unsure 877, 882: unknown amino acid
MAEPGHSHHLSARVRRRTERRIPRLWRLLLWAGTAFQVTQGTGPELHACKESEYHYEYTACDSTGSRWRVAVPHTPGLCTSLSDPVKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQXTTYVXREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGPDMDL

SEQ ID NO: 39 - DNA, 2998 bp, Homo Sapien
gggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggtgactttgcgggggtctcttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggtagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctatgagaatcttctcgacagttacttatggggacacttgtgaacaattaactgccagggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaaaaaaaa

SEQ ID NO: 40 - protein, 621 aa, Homo Sapien
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 41 - DNA, 889 bp, Homo Sapien
ctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgattt

SEQ ID NO: 42 - protein, 83 aa, Homo Sapien
MQFHASVPSLMLFLPTGMPSPAPPALSAWQVHLSRSPQRPPPPGRQPLCPSPPGYLCTLSMLLLWHLSHCILLVYMFVSPSRL

SEQ ID NO: 43 - DNA, 1356 bp, Homo Sapien
gtttccaacaaggatgatatgaagacttccctgaagaaagttgtgaagggacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccactgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaaaaaaaaaaaaaaa

SEQ ID NO: 44 - protein, 171 aa, Homo Sapien
MMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 45 - DNA, 2237 bp, Homo Sapien
gctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcgtgacacgccacctttaagaaccgtgacactcaacgctagggtccgcggcttcattcttgaagtcagtgagaccaagaacccaccaattccggacacggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacctgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagagggctgttaataacgatgatccatgtgttttactctaaagtgctaaatatgggagtttcctttttttactctttgtcactgatgacacaacagaaaagaaactgtagaccttgggacaatcaacatttaaataaactttataattattaaa

SEQ ID NO: 46 - protein, 586 aa, Homo Sapien [sequence omitted]

SEQ ID NO: 47 - DNA, 1808 bp, Homo Sapien
cactcattcattccaaagggtctctcaaggcaatggtaatgtgcaaggaggtgatacctaaatgaatgaccaaaagaacatgcttctgcttttgtgtgtctcctacattttagacatttgtttgtttctcttggtagcctttaaattccttgaagcccaggaccatgtctcacttacctttgtgtttccactaactagtctacctcctggaattggcagatactcagtgaaagcctgtgaaataagtgatgtctatttctagcatattattctgagatttaatgatagatttagtgattgaatgagatttccattttcaaatacagcaaaagcataactattttcattcattcatattcattcaacttcattctcaaaattaggtcctgagttaactaataattacctttgaaatgtgtgggttatttgaggcaatcaggtggtgacattgagctctcagccagagtttgtttctggaattgattcagttccattgcattgatttttgttctcagaagccaaggtttcccatgaaaaatcattcccacttgaattgggctgtgattcttgctgcgtttaagtaaaggaagcctcttggttctagttctgcaaacttacacactgaactgggacaagtttttgtttagagtaatggctgggaaaagaggaacctttcattttattcagaagtcaaaaacaaaggcctcccagccacctggagatgttttgttgcagacaccagcctggctctgtctttatgcctaacaattgagcatccagtcttctttgtgctgggaccattgctcagctctgcaaggggaaaagagggagaaagccagagctgccaggcttcttgcactggggccgggggagggttcctgggaagcaggtgctctctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaaacaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagacgaaaattcacaggctgaaccgttgtaagtccatatgctcctcaacttacatgtgtgatggagttatgcccaaataagtccatcgtcaagttgaaaaatcaaaatcaagccatcttaggttgaggaccatttgtttgtacctccaaagatgtcatatctttaaacatactccctagcttttctttttactttttattttgaagtaattatagaatcacagaaagttgcaaaaaa

SEQ ID NO: 48 - protein, 121 aa, Homo Sapien
MGALIISGSSAGPVTKQASLPPWGLSHGRCGFLLYMEMTLCSHRTQSFSELSQSLMRPGFLQMPYISCAKLSKIWFPASKPCLLAFLEVFLLMSRLSLFSKMICFLFLSFLFPPHIYTHAS

SEQ ID NO: 49 - DNA, 3719 bp, Homo Sapien
ggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgtgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacagatctcacttcccacctctccaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaactccgcattatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacatgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacggagtttcactcttgttgcccaggctggagggcaatggcgcgatctcagctcactgcaacctccgtctcctgggttcttgattctcctgtgtcagccttctgagtagctgggattacagatgcctatcaccatgcctgggtaatttttgtatttttagttgagatggggtttcgccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttggtggagacggggtttctccatgttggtcagactggtcttgaactcccgacctcaggtaatccgcccgcctccgcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttg

SEQ ID NO: 50 - protein, 477 aa, Homo Sapien [sequence omitted]

SEQ ID NO: 51 - DNA, 2014 bp, Homo Sapien
caggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttctttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaatt

SEQ ID NO: 52 - protein, 323 aa, Homo Sapien
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 53 - DNA, 4372 bp, Homo Sapien
tgggctccctccagcactgctgttgcctgctgcctaagatgggtgacacttgggcccagcttccctggcctgggccaccccacccagcaatgctgctgatctccctcctcttggcagccgggttgatgcactcggatgccggcaccagctgccccgtcctttgcacatgccgtaaccaggtggtggattgtagcagccagcggctattctccgtgcccccagacctgccaatggacacccgaaacctcagcctggcccacaaccgcatcacagcagtgccgcctggctacctcacatgctacatggagctccaggtgctggatttgcacaacaactccttaatggagctgccccggggcctcttcctccatgccaagcgcttggcacacttggacctgagctacaacaatttcagccatgtgccagccgacatgttccaggaggcccatgggctagtccacatcgacctgagccacaacccctggctgcggagggtgcatccccaggcctttcagggcctcatgcagctccgagacctggacctcagttatgggggcctggccttcctcagcctggaggctcttgagggcctaccggggctggtgaccctgcagatcggtggcaatccctgggtgtgtggctgcaccatggaacccctgctgaagtggctgcgaaaccggatccagcgctgtacagcagattctcagctggctgagtgccggggccctcctgaagtcgagggcgccccgctcttctcactcactgaggagagcttcaaggcctgccacctgaccctgaccctggatgattacctattcattgcgttcgtgggcttcgtggtctccattgcttctgtggccaccaacttcctcctgggcatcactgccaactgctgccaccgctggagcaaggccagtgaagaggaagagatctgacatgcctgcctctcatccctccatgctgctgaccgccacagctgctggccaccagacgccctccctgattgctcactctggttccatggtgacctggctgcctcagtcatggttcaagcaaggtggggacactcattttgtatgagcatctgctttgggccaggcggcacgctaggaattgggaacatcagatgaactgactcagtccctgccctcaaggcacttccctctggtcaaggagagagatccaaaaactattccctttaagactatatgtcaggactctgagcacgtcattatggaggcccagaggaggagccatcatctgtatctagcaatgtccatgagaattataagattagagtgatttgtgaactgggtcatcaggaaatatctactttgtcaggtaggcaaagaagggtgtctgcacatggcagaggccagaatatgcatagtgtgctgtgttgagaagagtgaacagttcctggtcacttacttgtatagagggggtgtggcacagaactcaaacctacccctcacctcctgacaccaaaactgtcagctctcagcaatgccagccactgcctacagggagtaagaacacctctatgacagcccctggcctccttccaccagcagctaccaggtgagaccacctcccagtgactgcccccatatgaccaaatgtcaccagttggtgaggtcccaggcagcaggctgaggatggacactttcaatgcccttgctcctgcctctcactcaagttttgcttcagaagagagaggcaggaggcccagcaactggggcagcaagagtcctggcaccttgggatcctaatcatgtgactgttcttgccacagtgctcatgccacagggtctcaccaggaaagtgcactgtgggccacagacccacagcctggcagcacccagagctaaaaggggacaaaggcagcacagttatgaccatatgaggctttgcattttcttctaagcaacttacccacgttaagcatgagggtgagagagctattaaatactaagcccttgccagtgtcaggtactttgaaaagctctctgcacaaaccattccctttgacacacacacacacaaatcttttgaggtgaacgctgttgttcccattttacggatgaggcaactaaggctcagagaggttaaagtcacatgccactatgagcaagataaagtctgtgctctttctactgccccatccaagttggggaacatcaccattccctctagagttatataaattcaaattcaactagagctgacaaagttcctcataaggtccaggcactcctctgggcacttttatatctattgactcacttctttcaattctcacagcaacactgcctggtggtttttattatccccatttgacagatgaattaatcgtagagagttgagtgacttacccaaggttgtctggataagccctagaaggaaggcggtaggcagctccattcagggaaactgcatctaatcagtcagtcaaaaatcaagtaactttacgagcaaagcacaattatcatcatcgtggtcttcttcatcagtttcgtcagcagcatcattatcttccctctatttgttcagcaccggatagttcatgagtatttttgcatcattctccttgacttttcacatccctgtgcaggaggtaaatcaaacatcagtaatcctgttttacagatggggaaaaaagtctcaaggttggatatgacttgctatgtggcaaggttggggctcaaccctaacacagttctctttccagtgctttctcaagtgcttggggaagagaatgcctcagaaggctgggtagtggggccctggaattcagcatccatgaatgtgctagtggataagctaaatagaaggcagccaaacccatctgctgtacagattgaactatgctcacggtagggcaaattgcaggctctgaaacagagactacacaggtaacacctgaataggagactcctgctttacaatgtgtagataaaacatcagcaatggtggccatggtggcagtcatgtgaaaagtaagatctttgggaatcaagaaaggaagctgtgttaaccactcctgctcaagccctgctgcgtgtgttgcaagagatactaagagagcaagaaagctataggtgagaacctctgcagtttaggagaagaacatcaaggcacagtccaacatgctgataagtctggccaggaggagaattaaaacaggggctttccacacctcccttgccccaagctccagcggtattctatcagcccatcctcctggaaagcctgaaaggaatgaaggaggctaataagtcatcttccaggaaggcatccctcactcgtgcttccctgagctagtcaaccaaaagagtcttcagaaactttgctagacctgaagtacttgaacctgtgtcccctgaatctttcttacaacatctgggacaaatccctggtcctgtgacatccgaagcagaactgtgccctgctctctccttctgtgatgaccaaggatggtgaactcaagttgttctctacaagccaggccagcaacctaaatacttggagaggaacttttagaaactataatcctgacaaaatagaaaagtttcccataggggcataccataatactataataacctcccaggaactattgtttgccaaaatgtagttaatatattttaagatatatgcttttttgcataggactagaaccagaaaagacaccaaatgcccccttgacatcaatgtcctttctagtgggacaatttggtctccattaatgccaaacctttctgaacaggatacatggcttttaaaggacagatgtttctcctgctgctagaagttcctcagtttactagagcacaatgaggaaagtattcaacctccctactgccaaggaattccctgcttctcccccaccgccatcatcttgtccaagctatcagaagcaaccttctagagataatctaacaatcctgattagaattgctcccatatccctggtgaccacaggcttcattcaaattgtccaaactggttaacatgtatgtgatggggtatctctgcatctgtatgtctgtctgcgaggttccttgtatattggctgtccgctgacttgggacagatctctctagaacttgggttcagttctctgacatagtccactcagccataggctgagtggctaaatatgcataaataagcatgcctaaataggcatatataggttggtgcaaaagtaattgcggtttttgccattaaaaatgatggcaaaaatcccaattacttttgcgtcaatctaatattacattgcttgatagattaagatggaatcccaccaggtttagggtaggactggatgctcaaaaaaaaaaaaaaaaaaaaaaaaaaaaaaaaaaaa

SEQ ID NO: 54 - protein, 281 aa, Homo Sapien
MLLISLLLAAGLMHSDAGTSCPVLCTCRNQVVDCSSQRLFSVPPDLPMDTRNLSLAHNRITAVPPGYLTCYMELQVLDLHNNSLMELPRGLFLHAKRLAHLDLSYNNFSHVPADMFQEAHGLVHIDLSHNPWLRRVHPQAFQGLMQLRDLDLSYGGLAFLSLEALEGLPGLVTLQIGGNPWVCGCTMEPLLKWLRNRIQRCTADSQLAECRGPPEVEGAPLFSLTEESFKACHLTLTLDDYLFIAFVGFVVSIASVATNFLLGITANCCHRWSKASEEEEI

SEQ ID NO: 55 - DNA, 2737 bp, Homo Sapien
ggctgcgcccaggccggcgggcccagcagctgcgaaccgccggcgcaccacctgtttccgcgcccggggacttccccggcggggctcagaagtgtggggtcggtcgcttggcttcccctggcgtcagcgacccagggtaacctcctccactgctgcgtgccgtgcaggcctgcctgtgtgagagccacgtgtgccgcgctctgggcacagccttggaaagtcaggaccgcgacggcagcagagcagaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcagtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcatggtgcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtcccccctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaactttaaaaaaaaaaaa

SEQ ID NO: 56 - protein, 525 aa, Homo Sapien [sequence omitted]

SEQ ID NO: 57 - DNA, 2443 bp, Homo Sapien
tggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgggcacagcgccattcctgcatgtgggggctgtggcagcagtcaccatgctctcctggatcgtggcaggacagttcgcccgtgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttgaaa

SEQ ID NO: 58 - protein, 486 aa, Homo Sapien [sequence omitted]

SEQ ID NO: 59 - DNA, 2550 bp, Homo Sapien
cctgagcaaacacagcagcccgagtgttcccaaggccaaaatgctgagaacgtccactcctaatctgtgtggtggtctgcattgccgggccccctggctctcttctggcattctctgcctctgcctcatattcttgttaggccaggtgggcttgctgcagggacacccccagtgcctggattacgggccccctttccagccccctctgcaccttgagttttgctctgactatgagtccttcggctgctgtgatcagcacaaggaccgccgcatcgctgcccggtactgggacatcatggaatattttgatctgaagagacatgagctgtgtggagattacattaaagacatcctttgccaggagtgctcgccctacgcagcccacctctacgacgccgaaaacacccagacgcctctccggaatctcccgggcctctgctctgattactgctctgccttccattctaactgtcactcagccatttccctgctgaccaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaacccttcctggacctcaagaacatcgtgttgaccaccccatggatcggggatgagagaggcttcttggggttggcttttcaccccaaattccgccacaatcgcaagttctatatttattattcgtgcctggacaagaagaaggtagaaaagatccgaattagtgagatgaaggtttctcgggctgatcctaacaaagctgacctgaaatcagagagggtcatcttggagattgaagaaccagcctcaaaccataatggcggacaacttctttttggcctggatggctatatgtacatattcactggggacgggggacaggctggagatccctttggcctgtttggaaatgctcagaacaaaagttccctgctgggaaaagttttaaggatcgatgtgaacagggcaggctcacatggcaagcggtaccgagtcccctcggacaatccatttgtttctgagccaggggcccaccccgccatctatgcctatgggatcaggaacatgtggcgttgtgctgtggaccgaggggaccccatcacgcgccagggccgaggccggatattctgtggggacgtgggccagaacaggtttgaagaggttgacctcattttgaaaggtggaaactatggctggagagcaaaggaagggtttgcatgttatgacaaaaaactttgtcacaatgcctctttggatgatgttctgccaatctatgcttatggccatgcagtggggaagtcagtcactggaggttatgtctatcgtggttgtgaatccccaaatctcaatggcctgtatatctttggagacttcatgagtggtcgacttatggctttgcaggaagatagaaaaaacaagaaatggaagaagcaggatctttgcctgggcagcaccacgtcctgtgccttcccagggctgatcagcacccatagcaagttcatcatctcctttgctgaagatgaagcaggggagctgtatttcctggcgacctcttacccaagtgcctatgcaccacgtggatctatttacaagtttgttgacccctcaaggcgagcacccccaggcaagtgcaaatacaagccagtgcccgtgagaaccaagagtaagcggatcccgttcagaccactcgccaagacagtcttggacttgctaaaggaacaatcagagaaagctgctagaaaatcttccagtgcaaccttagcttctggcccagcccagggtttgtctgagaaaggctcctccaagaagctggcttctcctacaagcagcaagaatacattgcgagggcctggtacaaagaagaaagccagagtggggccccacgtccgccagggcaagaggaggaagagcctgaaaagccacagtggcaggatgaggccatcagcagagcagaagcgagctggcagaagtctcccttgacctattggtcaaggtggccgacagggtgacgtgagagaggagagccacctcatcaaatgaaagtcactgctgaataaagaccttagaagtctgggaagccagggtagaggtggggcagggcggttttcctctccctgggaaatcttgctgtctactgaataaataaatgcaccttctctgtatgcagtgcttctgtgggagaccatatcccagattgctggtgcacctgggttatggtaagcactagtccatgagcctgcttggaatcacactggatgtctccgttttgtcttgtaaatgcctacaacctgaggtaataaatcaacatttgctca

SEQ ID NO: 60 - protein, 724 aa, Homo Sapien
MLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 61 - DNA, 2119 bp, Homo Sapien
ctccattaaaccaccaccagctccccaagccaccccttcagccatgaagttcctgctcctggtcttggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagaaacacacaaaggaaagacaagaagcaacaaacgaccgtaacatcataataaccactgctatcgcctccaccaactcagagaaatatcatttccacagttccaattcctcctacattgctgagtactagccaaggctcctctttatggggcagatatctatagccaaccccaaaacttctgtcttctatcattctgtcattcatctagtaactaatttggagtttgtatctatcttacgagaacaatcatcatgcagattcgtccacaggggatctgtcagtttgggtcctccaaatgaaaaatgtcaagacagaattggacatgcaaaagattgactgggagaacacacctctgatggacaaaggtgagacagagcagccacaggcagggagagccttcagactgcaacgctggcctgatacgtgtcaaaggagagagggatagaggaggattgaatagaaggagactaagactgcagctctaagaaagtctcagccaaacagatggggaggcccaaagcaaggcttgcccctcagaggagctcacgcagggcaggaatagccaggttctcatatcccaggggttcagacttggctgagaacagcccctggagaacatggggtgactgctaccataggtctggaagtatgaggctgtccaccaactatccccttgaagcaagttctcttgaaaggaaatctaaacagtgcacccccatggctgccacggagtataaggagggagagaaaggagctgaaagtctaggtttggccagctaggtagactgacttgtgaggtatttatttattcatttgagtaacaaagcagacagaatacatagccaccattggtagtacaccccaaaagcaaggatggcatgatgctggtgactcaaacgtgcctactcatggtgtcaaattggcataatcctcttgggaagctgtgtggaaataagcacagagaagcagaactctaattgcttaatccactaaacattacttctgggaattggctcatcataaattatccaagagaaagcacaaagttatgggcacaaaggttttccatataatattatttaaaatgctgagaaaatgaaaaaatctaaatggtgaaatatatactaatgccatctataaatacaaacaaatagaatgtttatagaataatggaacataataacattattcaaaattgcatttatgctatagttgtcaaaattgtctccttatatgatacaaaactcatgaaaattatgacttttttgtttggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtaca

SEQ ID NO: 62 - protein, 95 aa, Homo Sapien
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 63 - DNA, 2623 bp, Homo Sapien
gcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacaacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaaaaaaaaa

SEQ ID NO: 64 - protein, 504 aa, Homo Sapien
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 65 - DNA, 1606 bp, Homo Sapien
cggacgcgtggggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcatcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaa

SEQ ID NO: 66 - protein, 406 aa, Homo Sapien [sequence omitted]

SEQ ID NO: 67 - DNA, 4185 bp, Homo Sapien
cgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaaa

SEQ ID NO: 68 - protein, 745 aa, Homo Sapien
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 69 - DNA, 2916 bp, Homo Sapien
ggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcatgttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaagctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggcaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaaggtgaagtttttggcaattgttttattcaaatccaatagcaagctctgttttctaatatagtaaatgtctttatagtaatagtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacacaggctggagggcagtggcacagacatggcccattgcagtctcagactcctgggcttaagtgactcttctgccacagaagatgaggaagaatacatttttcatagtgatggggtctcactatgttatctaggctggtctcaaactcctggcctcaagcaaccctccaccttggcctcccaaagtgctgggactatagacatgaatcaccacactcagcttccatgtctttttatgaactagggttcctaattaatcagataaatttggtattttcatctcctaacttgccatatgttttctggaaattcttataagcagccgagagtggtggctcacgctgtagtcccagcactttgggaggctgaggtgggtggtcaggagatcaagaccatcctggccaacatggtgaaaccccgtctctactaaaaatacaaaaattagctgggtgtggtggcaggcacctgtagtcccagctacttgggaggctgaggcagaagaattgcttgaacccagcaggcggaggttgcagtgagctgagattgcaccactgcactccagcctggtgacagagtgagactctgtctcaaaaaaaaaaaa

SEQ ID NO: 70 - protein, 625 aa, Homo Sapien [sequence omitted]

SEQ ID NO: 71 - DNA, 3732 bp, Homo Sapien
aagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctgatgattactcattcattcgatattacacaaggaccctttaccaattccagtttcaagaagcactttgtcaagcagctaaacatgaaggccctctgcacaaatgtgacatctcaaactctacagaagctggacagaaactgttgtaagaaatacctcaaaatgttgaacctctcctagtattcagtattactcatttccatgcctaggtttgtatttgatttctttgttctaaaaagaaaattttatggcctcaaaatgtcctcatttacaaaccaaacatttaatttgtggtcagacaggaacctagaccatacaacaattgggtgggccacctcttttctccctatcataactacagccctctcttcctggtaattggaaggaaagagcggtttagggtggaatatatctgttaatatgcattcttttcttatctgccagaagcaaatttagccaagtcaaagagaagaaaccatagatcatagatgtaaatatatgtacatctggaacccctcaaaaggccctgaaccccctttttttgtgtagcaatatgctgaggcttggaaaatcagaaccctggaccctagcattggaaaatgttgtaggagcaagaacatgaatgtaaggccactgctcaactactttgagcccttatttacctggctgaaagaccagaacaagaattcttttgtgggatggagtaccgactggagtccatatgcagacccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactccccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacaaaa

SEQ ID NO: 72 - protein, 555 aa, Homo Sapien [sequence omitted]

SEQ ID NO: 73 - DNA, 2120 bp, Homo Sapien
cccacgcgtccgagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtca

SEQ ID NO: 74 - protein, 199 aa, Homo Sapien [sequence omitted]

SEQ ID NO: 75 - DNA, 3192 bp, Homo Sapien
  unsure 1428, 1431: unknown base
gcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccancangctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacattacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcaaaaaaaaaaaaaaaaaaaaaaaaaaaaaaaaaaaaaaaa

SEQ ID NO: 76 - protein, 184 aa, Homo Sapien
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 77 - DNA, 3567 bp, Homo Sapien
caccaacaagcaatcgttcatgagaaagccgtgcacccgctgcagttgggccatgtggtccgcatcgtattccactaggtccccattgtacaccaagtactgtcccggcgtctccagcagatgcctgcagccttccaccttctcaagcagggtggtgtgagtgcgctgctttccttcctcgcctggaccggagccgtcgcgggaggcacccccgggggtggagaaaaagccggcctggcctcggaggtggtctcggccccccgccccaccgactccctcctcccctccagaggcggcggcggctccggcggcagcagcggcaggcagcaacgtaagcgggatgctctccaggctgcttttctgctcggtcagcaaatggctgagctggtacatctcgctctccaggtaggagatctcgcgggccgtctctatgaactgccggtagttctggtagacgttgcgcttcaggttctgcgccgtctcctccgccagcgcctggatgcgctgccggtgctcctggaggtcccggtccccatccgactgctgcgagagctgcttcacgtacagccgcgcctcaaaaccccctgactccagctgccgacgcaggcggctcgccccactgtccgacatcgccatcgccatttctctccgggtctcacgcactcactgtcactatcggcgccgcagccgccgcggctgtctagacccacccaaggccaaccgagctcctgggctgaggaagcaggaatgggaacgagacgagtacgcctgcgccgggtctgagcgtcagacactgcgcctgcgcaagtgggccgagcgcagacattgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatccttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgtacattagtttaatgtttgttactgtatttcttttgagttgaggcacttacataacaatcttctttgcttttttggcagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataaaaaaaaa

SEQ ID NO: 78 - protein, 250 aa, Homo Sapien
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKGTFVYILLIFM

SEQ ID NO: 79 - DNA, 2714 bp, Homo Sapien
cggacgcgtgggtggcaaccaggagaagccaaacttggtcccccggctcgcggagtgcctgcgagcggtgctcatggcgctctatgaggtcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtacagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttcttccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcatcttattaaattattctaatgcaaatcttgtataaagaacccatgatgttttgtaactttctaattaaaatgttcaaaatgag

SEQ ID NO: 80 - protein, 316 aa, Homo Sapien [sequence omitted]

SEQ ID NO: 81 - DNA, 3233 bp, Homo Sapien
gccgggagcttccctgatggtgccgccgcctccgagccggggaggagctgccaggggccagctgggcaggagcctgggtccgctgctgctgctcctggcgttgggacacacgtggacctacagagaggagccggaggacggcgacagagaaatctgctcagagagcaaaatcgcgacgactaaatacccgtgtctgaagtcttcaggcgagctcaccacatgctacaggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaaaaa

SEQ ID NO: 82 - protein, 406 aa, Homo Sapien
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 83 - DNA, 443 bp, Homo Sapien
atctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattc

SEQ ID NO: 84 - protein, 80 aa, Homo Sapien
MKLSGMFLLLSLALFCFLTGVFSQGGQVDCGEFQDPKVYCTRESNPHCGSDGQTYGNKCAFCKAIVKSGGKISLKHPGKC

SEQ ID NO: 85 - DNA, 2750 bp, Homo Sapien
ggagcagacacacagacccgggccggaggcccctcttctagccctgcgggaaccggacagttccccaactggggactctggaaccacagctcctaaatcatcaaattctcaagctttttttttccctctcttcgtcccagccatcccagtcttcttcttcttttttttttttttaacttattgtttttttcgctcctgtcattatgaaagtggtcacgccattcaatattaagacttggagggaattggggaaagaaaagaaagaatctaaaagaagagaagcgaccggtgcttttaagggtgtctaattttcaaaagagacgtctgggagtattttgctctgggcgtttggagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagcctggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggcaaaaaaaaaaaaaaaa

SEQ ID NO: 86 - protein, 224 aa, Homo Sapien
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 87 - DNA, 2159 bp, Homo Sapien
agggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcactgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttaca

SEQ ID NO: 88 - protein, 685 aa, Homo Sapien
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 89 - DNA, 1893 bp, Homo Sapien
gtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgaaaaaaaaaaaaaaaaaaaa

SEQ ID NO: 90 - protein, 468 aa, Homo Sapien
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 91 - DNA, 1240 bp, Homo Sapien
tgcatcagtgcccaggcaagcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgcaaaaaaaaaaaaaaaaaaaaaaaaaaaaaaaaaaaaaaaaaaaaaaaaa

SEQ ID NO: 92 - protein, 199 aa, Homo Sapien
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQESLLSGPPRQ

SEQ ID NO: 93 - DNA, 2285 bp, Homo Sapien
ggcggcgttgccgggctctccggaaggagacgtggcggcggttgggccggtgatacccgggcgctttatagtcccgccgcctcctcctccacctcctcctcctcctcctctcctcctggggcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaaaaa

SEQ ID NO: 94 - protein, 429 aa, Homo Sapien
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 95 - DNA, 2542 bp, Homo Sapien
ttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacaaaaaaaaaaaa

SEQ ID NO: 96 - protein, 716 aa, Homo Sapien
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 97 - DNA, 1571 bp, Homo Sapien
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctctcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataccaaaaaaaaaaaaaaaaaaa

SEQ ID NO: 98 - protein, 176 aa, Homo Sapien
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 99 - DNA, 1904 bp, Homo Sapien
gcgccggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgtttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccataccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 100 - protein, 308 aa, Homo Sapien
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 101 - DNA, 2031 bp, Homo Sapien
  unsure 2020: unknown base
aatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagatgacctaactgaaggaatccttgtatatgaaaggagttattttagaaaagcaataaaaatattttattcatcntaaaaaaaaaa

SEQ ID NO: 102 - protein, 607 aa, Homo Sapien
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 103 - DNA, 2099 bp, Homo Sapien
cctaattctcaaggtgatgctatttaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggcagaagatccacctagaggtgataccacggcggcgcagagttgttcacctgtggtcctcgatcgctgacagccttggctcccactgctgtgtgttccctgagtcaagtggaggcggagcctgcaatgagcggagatcgcgcctctgcattccagtcttggcaacagagcaagactccgtctcaaaaaaaaaaaattttttttcagtacatattttttaaaagatagggctgggcacagcagctcacatctataatcccaacactttgggaggcctaggcaggaggatcacttgagcccaggaatctgaagctgcagtgagcctttgctcgtgagattgtggacctatgatcctaccaccagcccacctggttctaacaccccctcctctatgtgtgagagggagagaagaaaagtgagggagaaaagagagataagcaaagaacagagaggaaaaatggaaaataagaggaaattgggggaattaaacagaggggagggcatggatccccgggagttagaagagtagcagcttgtggattactacgcagtggaggaagaagagttgttggaaattatttgagaggtagtataatcatttgtgaggcagttttctgcattcaccatttctcacagactaagttactcataagcaaacgtgcaattcacattacactgaaattcttccctaatacatcatttgcattggaataaagtacggttttcaaacaacctgatatagcagaactgactgtataaattatgtgagcacagtgcaagtaattctttgtttgtttgtttgtttttttgagacagagtctcactctatctcccaggctggagtgtagtggtgcgatcccggctcactgcaacctcgatctcccaggctcaagcgattcccctgcctcagcctcctgagtagctgggattacaggcatgagccaccacgcccggctaatttttgtatttttagtagagacggggtttcaccctgttggccaggctggtctcgaactacggacctcaggtgatctgcccccctcagcctctcaaagtgctgggattatagcatgagccactgagcccagacacaagtagttctttctgataaacactttaacactgaatgca

SEQ ID NO: 104 - protein, 212 aa, Homo Sapien
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGRRST

SEQ ID NO: 105 - DNA, 1975 bp, Homo Sapien
ttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacaatcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactgg

SEQ ID NO: 106 - protein, 372 aa, Homo Sapien
MLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 107 - DNA, 2343 bp, Homo Sapien
aacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattccttaaaa

SEQ ID NO: 108 - protein, 509 aa, Homo Sapien
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 109 - DNA, 1113 bp, Homo Sapien
ggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtga

SEQ ID NO: 110 - protein, 249 aa, Homo Sapien
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 111 - DNA, 3162 bp, Homo Sapien
cgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaaccatttaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaaaaa

SEQ ID NO: 112 - protein, 910 aa, Homo Sapien
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 113 - DNA, 3323 bp, Homo Sapien
gccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttttttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaaaaaaaa

SEQ ID NO: 114 - protein, 525 aa, Homo Sapien
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 115 - DNA, 2314 bp, Homo Sapien
ggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcactgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctccc

SEQ ID NO: 116 - protein, 715 aa, Homo Sapien
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 117 - DNA, 1422 bp, Homo Sapien
cccacgcgtccgcggacgcgtggggctcagtgggcgtcgcgcgaaggctaagggagtgtggcgggcggctccgggagccaacatgcctcggtatgcgcagctggtcatgggccccgcgggcagcgggaagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacatctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggccggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagat

SEQ ID NO: 118 - protein, 284 aa, Homo Sapien [sequence omitted]

SEQ ID NO: 119 - DNA, 2868 bp, Homo Sapien
gggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgtcaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaagatcctggcagcatacagggtgttcatggagcgagtgctcagcctcctgggtgcagacgctgtggaacagaaggcccaagagatcctgcaagtggagcagcagctggccaacatcactgtgtcagagtatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagccgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccccttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcgtcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgttaaaaaaaaa

SEQ ID NO: 120 - protein, 775 aa, Homo Sapien [sequence omitted]

SEQ ID NO: 121 - DNA, 1806 bp, Homo Sapien
cggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccacaaaaaaaaaaaa

SEQ ID NO: 122 - protein, 511 aa, Homo Sapien [sequence omitted]

SEQ ID NO: 123 - DNA, 3479 bp, Homo Sapien
cggacgcgtgggggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggatctctcagtctccccggactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagagaaactcactgcagagctggaaaagcttcagacagagcttgactggagacgggctgaaggccaggctgagtggagagcagcccaaaaatatgcagtggatgtgacgctggacccggcctcggcgcaccccagcctggaggtgtcggaggatggcaagagcgtgtcttcccgcggggcgccgccaggcccggcgcctggccacccgcagcggttctcggagcagacgtgcgcgctgagcctggagcggttctccgccggccgccactactgggaggtgcacgtgggccgccgcagccgctggttcctgggcgcctgcctggccgcggtgccgcgcgcggggcctgcgcgcctgagccctgcggccggctactgggtgctggggctgtggaacggctgcgagtacttcgtcctggccccgcaccgcgtcgcgctcaccctgcgcgtgcccccgcggcgcctgggcgtcttcctggactacgaggccggagagctgtccttcttcaacgtgtccgacggctcccacatcttcaccttccacgacaccttctcgggcgcgctctgtgcgtacttcaggcccagggcccacgacggcggcgaacatccggatcccctgaccatctgcccgctgccggttagagggacgggcgtccccgaagagaacgacagtgacacctggctacagccctatgagcccgcggaccccgccctggactggtggtgaggcgccctcgtggccgcgggactggccccggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctgagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattctctctgtcggccaggctggagtgcagcctcaacctcctgggcccaagtgatcctcccacctcagcacacaacaccatgcccaattttaagtgcgttatagagacgggggtctcactttgttacccaggctggtctcaaactcctgcgctcaagcaatcctcccacctgggcctcccaaaatgctgggtgtacaggcatgagccgctgtgcctggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagtaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacacttttca

SEQ ID NO: 124 - protein, 535 aa, Homo Sapien
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAEWRAAQKYAVDVTLDPASAHPSLEVSEDGKSVSSRGAPPGPAPGHPQRFSEQTCALSLERFSAGRHYWEVHVGRRSRWFLGACLAAVPRAGPARLSPAAGYWVLGLWNGCEYFVLAPHRVALTLRVPPRRLGVFLDYEAGELSFFNVSDGSHIFTFHDTFSGALCAYFRPRAHDGGEHPDPLTICPLPVRGTGVPEENDSDTWLQPYEPADPALDWW

SEQ ID NO: 125 - DNA, 4374 bp, Homo Sapien
tatagtcccagctactcatggggctgatgcaggttgaggcaggaggttcatgagcccaggaggttggagctgtaatgagctaggattctgcctctgcactcctagctggatgacagagcaagaccctgtctcaaaaaagaaaaaaaaaaaaaaaagaatgcatgaaccagacatgacagttcctggcctcaaagatcttccaaaggaaatgatttttttttaaccaccaatgctgcaggaaaaagcaacatatttaagttatccaataacacctatccaataattgtaaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcatcatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcattgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttg

SEQ ID NO: 126 - protein, 451 aa, Homo Sapien
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 127 - DNA, 2163 bp, Homo Sapien
agccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacactgacaccccgtgcagaggggcaccctcctacgcacaccatctccaccatcgctgcgacagtaaccgccccctattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccagagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatatatatattataaatataaccttgtgtaaccctgacttaatgagaaacattttcagctttttttcctatgaattgtcaacatcttttttacaagtgtggtttaaaaaaaaaaaaactttacagaatgatctgtggctttataaaataaaggtatttctaagcaaaaaaaaaaaaaaaaa

SEQ ID NO: 128 - protein, 575 aa, Homo Sapien [sequence omitted]

SEQ ID NO: 129 - DNA, 2334 bp, Homo Sapien
aggcgaggcgcggcgccgctgcacacacgcacacggagctatggggtgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggtcggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactcttcaggaaggggctcccttgacctaggttgcaatatggaaaaggagccaacctgaggggtgacgagactgagctgaggacactggttttctgcctttccctgagagagactcagtgagggtgggctgggagccctggaagccccctcaaatgggtgggaaggtgccagccatccttgagaagggcaaccctctccatgtgagcacaggcaccagagaggggcaggcgcctggagggtaccggggcacccccagctgcccatggctggacttgccctttgacaaggggccctcccagtgtcatttgtatctgtcagtactcttggttgcaagggacagaaacccttaagtagttcaagcaaaaaaggattggctcatgtaactcaaaagtataagtgatttcaggccgggctcggtggctcacgcctgtcatccaacaccttgagaaagccgaggtgggcggatcacttgaggtcgggagtttgagaccagcctggccaacatggcaaaaccccgtctctactaaaaatacaaaaattagccgggtgtggtggcacacgcctgtagtcccagctactagggaggctgaggcaggagaatcgcttgaacccaggaggcggaggttgcagtgagccgagattgtgtcactgccctccagcctgggcgacagagccagattctgtctc

SEQ ID NO: 130 - protein, 530 aa, Homo Sapien [sequence omitted]

SEQ ID NO: 131 - DNA, 1840 bp, Homo Sapien
gtgggccgcccctgctgctgccgtccatgctgatgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaagttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcctttgaggttgtgactgtggctggtatatctggctgccatttttctgatgcatttatttaaaatttgtactttttgatagaacccttgtaagggctttgttttcctaatagctgactttttaataaagcagttttatatat

SEQ ID NO: 132 - protein, 333 aa, Homo Sapien
MLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 133 - DNA, 1636 bp, Homo Sapien
cggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggatgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctc

SEQ ID NO: 134 - protein, 319 aa, Homo Sapien [sequence omitted]

SEQ ID NO: 135 - DNA, 1675 bp, Homo Sapien
ggcacgagggagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctgaaaaaaaaaaaaaaaaaaattcct

SEQ ID NO: 136 - protein, 278 aa, Homo Sapien [sequence omitted]

SEQ ID NO: 137 - DNA, 2207 bp, Homo Sapien
  unsure 2153, 2160: unknown base
cacgcctcccgctgccagcccggcaccgggatcttaatcagtcactatgaaaactcattagctccacagcaatgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatctcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaanacactgnaattttaaaaaaaaaaaaaaaaaacaaaaaaaaaaaaaaaaaaaaaa

SEQ ID NO: 138 - protein, 478 aa, Homo Sapien
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 139 - DNA, 1971 bp, Homo Sapien
gaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaaggagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcgga

SEQ ID NO: 140 - protein, 539 aa, Homo Sapien
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 141 - DNA, 3671 bp, Homo Sapien
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaaaaaa

SEQ ID NO: 142 - protein, 1036 aa, Homo Sapien
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 143 - DNA, 1985 bp, Homo Sapien
gacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctgccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttggaaaaaaaaaaaaaaaaaaaaaaaaaaaaaaaaaaaaaaaaaaaaaaaaaaaaaaaaaaaaa

SEQ ID NO: 144 - protein, 520 aa, Homo Sapien
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 145 - DNA, 3884 bp, Homo Sapien
gccggctagggcgccggagccgcacgcagccgcggggctccgagaggcgcgcactggggctgggactgcgcggcgccgccgctgcgagcgccactgagcggtcgcgcaacttcggaggcacagcgccggagccaggcgagcgctcagagacccggagccagaggggcgcgccggagcctcgttcgagagccggcgccaggcacccaccgcgctccgagtgccaggcggccctccgcgcagcgtggcttccgctgcccccacggaaggcacgggctggcgctgccgggcgccggggaggacggcgaggaggaggcggcggcggcggagacggcggcggcgagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcaggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccgtgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaaaa

SEQ ID NO: 146 - protein, 945 aa, Homo Sapien
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 147 - DNA, 3734 bp, Homo Sapien
gagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccggagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctacaggtgtcacccgttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcaggtaacgccactaatcaggcaggggccaccatggcctaggtctgggctggctgcaggccctgcctcatggcctctgagccctccactgccccagggccttgggccctctgcagatctcatccaggatttattgttgtccagtggggtgagggaggcctgtctgaaggccgagcctccctgcctgcacccaagttagaaatgggggtaccagcacttagcttctctctgagtgctggctcccaaggaagggacctgggacctgggccacagtgggggcttgcccttacctcttcagaaggaagcatcttccacagcccccacccaactttcttaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttcaaaaaaaaaaaaaaaaaaaaaaaaaaaaaaaaaaaaaaaa

SEQ ID NO: 148 - protein, 834 aa, Homo Sapien
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARTLMAGVGLSFLFAAPLILLVFATFLVGGNVQTLVCRSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 149 - DNA, 804 bp, Homo Sapien
cacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactca

SEQ ID NO: 150 - protein, 81 aa, Homo Sapien
MRLLVLSSLLCILLLCFSIFSTEGKRRPAKAWSGRRTRLCCHRVPSPNSTNLKGHHVRLCKPCKLEPEPRLWVVPGALPQV

SEQ ID NO: 151 - DNA, 2164 bp, Homo Sapien
caccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtgccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggatcgaggaggaggatttgggttgttttgttaggggttactttcaggggaacatttcatttgtgttatttcttaaacttctatttaggaaattacattaagtattaatgaggggaaaggaaatgagctctacgaggatttcaccttgcatgggagagagcagggttttctcagattcctttttaatctctatttatctggttgtttctgacaggatgctgcctgcttggctctacgagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagactgtttgctttatacccacacagcaactggtccactgctttactgtctgttggataatggctgtaaaatgtttaaaaac

SEQ ID NO: 152 - protein, 310 aa, Homo Sapien
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 153 - DNA, 755 bp, Homo Sapien
  unsure 67: unknown base
acgtcactgtcttgaagcagcagtagcctgggaagtgaggcaggaggaattgagaggcaggaagggngctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgggtctgttcctggtttcccagatgcataaaggaagacatatccctcccctgggcagcaaggctacaatgggagggagggagaacatgggagcatgtgaataaaatggcattaaatactgaaaaaaaaaaaaaaaaaaaaaaaaaaaaaaaaaaaaaaaaaaaaaaaaaaaaaaaaaaaaaaaaaaaaaaaaaa

SEQ ID NO: 154 - protein, 105 aa, Homo Sapien
MLVHCVGLLLTGLLLGLTLGAGALLASEPIYQPPSAWVPAGGLVGLALLGALLTLRWPRPFTVLGTTLLGSAVLVACVDYFLEGLALGSWLGQRLQTLPALPSLC

SEQ ID NO: 155 - DNA, 1825 bp, Homo Sapien
tgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacggggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacaaaa

SEQ ID NO: 156 - protein, 244 aa, Homo Sapien
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 157 - DNA, 1328 bp, Homo Sapien
ccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctggtcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaa

SEQ ID NO: 158 - protein, 190 aa, Homo Sapien
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 159 - DNA, 2167 bp, Homo Sapien
gctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcctctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacactagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcccagcaaaa

SEQ ID NO: 160 - protein, 605 aa, Homo Sapien [sequence omitted]

SEQ ID NO: 161 - DNA, 1376 bp, Homo Sapien
ccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaaaa

SEQ ID NO: 162 - protein, 343 aa, Homo Sapien
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 163 - DNA, 1968 bp, Homo Sapien
caaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccctctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagaggggaggatggagactcagagagagaggaagatggagactcagagggaaagatggagactcaggagtatggagagtcagagaggggaggatggacactcaggggaggatggagagtcaggaggatggagactcatagaaaggggaggatggagagtcaggagaggttggagactggagagggaatagagacccagaaaggggaggatggagactcagagggtggaagatggagactcaaagaggatggaaacccagagagaggaggacagagatgaggcagagactaggggaagcaggatagcgactggtcgggggcagagactcagggaggatagagactcacagagaggtgaggatagagacttgggagggactcaggaagcatagcgactgtggggcaaagagtcagagaggggaggatacagacttgggagggcagagactcagaaacagaatgttcgcattagggacatggtgttgcggggagctgcctcccccagcccctgctccctccctcaccgccagactatgatgagagaagccacctgcatgacaccttcacccagatgacccatgccctgcaggagctggctgctgcccagggatcctttgaggttgccttccctgatgctgcagagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtcctcggggccctcgcatcagcgagtgcgacagtgttggcgtggtgagttctggggactccggagccccagcatctagctccccgctgtctcagatcccaccgagaagtctgggttcccagcaacctccaacccaggaggatgttctttcgatggtactgcagtggcaactaacaaaggtatctttcctccttccctatcctatttccatcctgaaaataaagaatatatttcaactctaaaaaaaaaaaaaaaaaaaaaaaaaaaaaaaaaaaaaaaaaaaa

SEQ ID NO: 164 - protein, 243 aa, Homo Sapien
MALLALASAVPSALLALAVFRVPAWACLLCFTTYSERLRICQMFVGMRSPKLEECEEAFTAAFQGLSDTEISEETIHTSSVSWGRCRGRAGEAQRVRLRDRQRETVRGERLKDHENNRDLGTERHRQGKTAGQRLREGRMESQRGEDGDSERGEDGDSEREEDGDSEGKMETQEYGESERGGWTLRGGWRVRRMETHRKGRMESQERLETGEGIETQKGEDGDSEGGRWRLKEDGNPERGGQR

SEQ ID NO: 165 - DNA, 1941 bp, Homo Sapien
cagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggatcgctgggccctaggctcttgcttctggggctattggagggtcagtgtctgtgactgaataaagttccattttgtggaaaaaaaaaaaaaaaaaaaaaaaaaaaaaaaaaaaaaaaaaaaaaaaaaaaa

SEQ ID NO: 166 - protein, 301 aa, Homo Sapien
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 167 - DNA, 3323 bp, Homo Sapien
ggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccaggggttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaa

SEQ ID NO: 168 - protein, 196 aa, Homo Sapien
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 169 - DNA, 1664 bp, Homo Sapien
caaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttaaaa

SEQ ID NO: 170 - protein, 349 aa, Homo Sapien
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 171 - DNA, 756 bp, Homo Sapien
gccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaaaaaaaaaaaaaaaaaaaaaaaaaaaaaaaaaaaaaaaaaaaaaaaaa

SEQ ID NO: 172 - protein, 182 aa, Homo Sapien
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 173 - DNA, 1210 bp, Homo Sapien
gctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 174 - protein, 182 aa, Homo Sapien
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 175 - DNA, 2027 bp, Homo Sapien
cgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacagttggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaaaaaaaaaaaaaaaaaaaaaaaaaaaaaaaaaaaaaaaaaaa

SEQ ID NO: 176 - protein, 301 aa, Homo Sapien
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 177 - DNA, 959 bp, Homo Sapien
gccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggtagttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtc

SEQ ID NO: 178 - protein, 229 aa, Homo Sapien
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKGIVTHMSSWVEESVLFFW

SEQ ID NO: 179 - DNA, 2134 bp, Homo Sapien
  unsure 2108: unknown base
cagatttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcagaatcaggctttcaacatcttgaaaaccttgcttgtttgtatttaggaagtaataatttaacaaaagtaccatcaaatgcctttgaagtacttaaaagtcttagaagactttctttgtctcataatcctattgaagcaatacagccctttgcatttaaaggacttgccaatctggaatacctcctcctgaaaaattcaagaattaggaatgttactagggatgggtttagtggaattaataatcttaaacatttgatcttaagtcataatgatttagagaatttaaattctgacacattcagtttgttaaagaatttaatttaccttaagttagatagaaacagaataattagcattgataatgatacatttgaaaatatgggagcatctttgaagatccttaatctgtcatttaataatcttacagccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgttttttnttaaaaaaaaaaaaaaaaaaaaaaaa

SEQ ID NO: 180 - protein, 622 aa, Homo Sapien
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 181 - DNA, 1624 bp, Homo Sapien
  unsure 1560-1561: unknown base
ggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagtttnnttccaaaaaaaaaaaaaaaaaaaaaaaaaaaaaaaaaaaaaaaaaaaaaaaaaaaaaaaaaaa

SEQ ID NO: 182 - protein, 120 aa, Homo Sapien
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 183 - DNA, 2823 bp, Homo Sapien
ctaaaaaatacaaaaattagctgggcgtggtgtcatgtacctgtaatcccagctactcaagaggctgaggcaggagaatcgcttgaacccaggaggcagaggttgcagtgagccaagattaagtcactgcactccagcctgggtgacagagcaagactctgtatcaaaataaataaataaagtacaactctggatgggcatggtggcttatgtctgtaatcccagcactttgggaacttgaggcgggtagattgcttgagtccgggagtttgagaccagtctgggtaatatggtaaccctgtctaccaaaaatacaggtattagccagtctcataactcggtctcaaaataaataaatacatacatacatagatgaaaatttaaaaaataaagtccaactcagcggttttcagcatatttacagagttgtacaatcttcaccactatctaatttcagaacattttcatcacccccaaaagaaacctaacccattgactatctctccatttcctccctctccctagcctctggcaaccactaatctcttttttgtctctatagatttgcctattttggacagttcatatacaaggaatcataccacatgtagccttttgtgtccggcttctttgattaatagaatgttttcaaggctcatctatgctgtagcctgtatcagcacttcattcctttctatggctgaataatagtccactgtagggatgtgccatgtttttccactagctgatggacatttgggttgtttccaccttctggctattataaatattgctgctataaatattcacttacaagtttttgtgtggacatatgtttttatttcttctggtatatccttcggagtggaactgctggatcaggtggtaactctaggtctaacctggcagttaaacagaatcctatgcatgctgtagtccatgagttgaaataaacacttgacccatagtaagtgccagatcatcttcatttcacagcaaccagtaatttcacagatgaggaaatgaaggctcccagaggtgaactggcttttcccatttgagcagttccaagtcagacagttaaaaagtggcaggacctggaagagaagctagttctttcaccctggcattcagggctgcctcctgggctacggggctggcatttagaatagagctaaggtctgctgccaaggcaggtgccccagtctgcctcctctgtgtccttattccactttctctgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtacgctcatctgtggccatgttatctcccgagatgcactcaataagctcattaatggaggaaacactccgtgttcgcttgccccatcctccgccagcagacgtcagattccaaccctcccatcaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcaaaa

SEQ ID NO: 184 - protein, 331 aa, Homo Sapien
QCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 185 - DNA, 1162 bp, Homo Sapien
gagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgcgattgtatctgcagctcaagaccacctcgataagagaatgtgcacatccttacattaagcctgagagaa

SEQ ID NO: 186 - protein, 364 aa, Homo Sapien
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 187 - DNA, 1750 bp, Homo Sapien
catgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaa

SEQ ID NO: 188 - protein, 542 aa, Homo Sapien
MPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 189 - DNA, 2150 bp, Homo Sapien
atgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatacctgatgttatatatacatggtcaataaaataaaactggcctgacttaagataaccattttaaaaaattgggctgtcatgtgggaataaaagaattctttctttcctaaaaaaaaaaa

SEQ ID NO: 190 - protein, 613 aa, Homo Sapien
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 191 - DNA, 1647 bp, Homo Sapien
gcttcagctgaagaaagagaggaatgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggtacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaaggattcccgcagagagtggtaaaacactttcctggaatcagtatccgtgttgatgctgctttccagtacaaaggattcttctttttcagccgtggatcaaagcaatttgaatacaacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaac

SEQ ID NO: 192 - protein, 513 aa, Homo Sapien [sequence omitted]

SEQ ID NO: 193 - DNA, 702 bp, Homo Sapien
cacaatcaggtcccattctatagatggggaaactgaggcttgaggtcacataggcgtcgttcaaggctggtatacctgcaccctctcccatgtgaacaacatggttctgggtaatgggggctgtcatccagtctcctccctgcccctgctggtgcacttcctgcctctgctggtgcactttctgcccctactggtatatttgctgcctctgctggggcgcttcctgcctcggctggtgtatctcctgcccctgctggtgcactttctgcccccgctgatgcacttcctgcctctgctggtgcacttcctggctctgctggcacacttcctgcctctgctggtgcacttcctggctctgctggcgcactttcctgcccctgctggtgtatttcctgcccctgctggtgtacttccttcccctgctggtgcacttcctgcctctgctggcgcacttcttgcctctccaggccctacctagcctctccctcttatatatggaagtcttcccagttcactgacactggtaacagggactctgctcttggtgttgctgtctgccctggggatgggcatctgtgtcttcctttactactgctggctcaggacccagagctttgaagcatgtccagatgcaggtccgggcaccagagtctaaggagcccctacacccaccaggattttccaataaagagatgttcacca

SEQ ID NO: 194 - protein, 125 aa, Homo Sapien
MVLGNGGCHPVSSLPLLVHFLPLLVHFLPLLVYLLPLLGRFLPRLVYLLPLLVHFLPPLMHFLPLLVHFLALLAHFLPLLVHFLALLAHFPAPAGVFPAPAGVLPSPAGALPASAGALLASPGPT

SEQ ID NO: 195 - DNA, 2475 bp, Homo Sapien
ggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatgggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctggaaaaaaaaaaaaaaaaaaaaaaaaaaaaaaaaaaaaaaaaaaaaaaaaaaa

SEQ ID NO: 196 - protein, 552 aa, Homo Sapien
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 197 - DNA, 4060 bp, Homo Sapien
gcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgtattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacgtgtgggaggaatttttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactcccaaaaaaaaaaaaaaaaaaa

SEQ ID NO: 198 - protein, 1024 aa, Homo Sapien [sequence omitted]

SEQ ID NO: 199 - DNA, 3461 bp, Homo Sapien
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggatcgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaagcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaaaaaaaaaaaaaaaaaaa

SEQ ID NO: 200 - protein, 1023 aa, Homo Sapien
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEAEAAAETSLEGGNMALAIFIPVLIISLLLGGAYIYITRCRYYSNLRLPLMYSHPYSQITVETEFDNPIYETGETREYEVSI

SEQ ID NO: 201 - DNA, 2806 bp, Homo Sapien
  unsure 2157: unknown base
gatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagntcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccc

SEQ ID NO: 202 - protein, 709 aa, Homo Sapien
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 203 - DNA, 2695 bp, Homo Sapien
gctagaccgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaaa

SEQ ID NO: 204 - protein, 790 aa, Homo Sapien
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 205 - DNA, 2782 bp, Homo Sapien
cggacgcgtgggcggacgcgtgggcggacgcgtgggggaaggttgaatggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaaggctgtggaccacctgtcgagatggagaagtccttctgaggctatccaaacacggaccaggccatgagaccccgatgaccatccctgaattttttcgagagtcagtcaaccgatttggaacttatccagccctcccatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccaaaaaaaaaaaa

SEQ ID NO: 206 - protein, 616 aa, Homo Sapien [sequence omitted]

SEQ ID NO: 207 - DNA, 2845 bp, Homo Sapien
cccacgcgtccgcccacgcgtccgcggacgcgtggggccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaatgctgggcttttctctgtaagctggttctgcagcacaattcattaattaaacttctcccagtgcaagaaggcagctggtgctgggggtggtctggggggtcagggaggagggcaaggactacatggggcagaggcaaggcggtggtggagatgaggaaagaagttcttcttggcagaagctggggcagaaagatcacatgagatctgtggggacaccctctatctgaaacataagtctgtgttcattctctgcttagaaattttagatctgaagtgctacactgaaggtccgaaggttgatggggcatcagatatctttttggttggccagcatgatattttgaaataactgtcaacagttagaaactgggagcattcatatgtaaaaaatatggattttcagcttcttcttaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 208 - protein, 367 aa, Homo Sapien
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 209 - DNA, 2915 bp, Homo Sapien
ctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttacatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataaagggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaataa

SEQ ID NO: 210 - protein, 519 aa, Homo Sapien
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 211 - DNA, 3266 bp, Homo Sapien
gtggggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggca

SEQ ID NO: 212 - protein, 747 aa, Homo Sapien
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 213 - DNA, 1955 bp, Homo Sapien
gcacgaggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggtaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcactgaccacaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtcccgtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggaaaaaaaa

SEQ ID NO: 214 - protein, 245 aa, Homo Sapien
MAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 215 - DNA, 1567 bp, Homo Sapien
cagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaaga

SEQ ID NO: 216 - protein, 379 aa, Homo Sapien
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 217 - DNA, 1633 bp, Homo Sapien
gagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgattttttttccttgagctgtaaatctgtgacttctgcgacatgggatttaatttggctaaagcacccctgttggtttcacagctggtttgcaataaatggttcttggtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 218 - protein, 426 aa, Homo Sapien
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 219 - protein, 1076 aa, Homo Sapien
CTGTGAGTGACACACGCTGAGTGGGGTGAAGGGAAATGCTGGTGAATTTCATTTTGAGGTGTGGGTTGCTGTTAGTCACTCTGTCTCTTGCCATTGCCAAGCACAAGCAATCTTCCTTCACCAAAAGTTGTTACCCAAGGGGAACATTGTCCCAAGCTGTTGACGCTCTCTATATCAAAGCAGCATGGCTCAAAGCAACGATTCCAGAAGACCGCATAAAAAATATACGATTATTAAAAAAGAAAACAAAAAAGCAGTTTATGAAAAACTGTCAATTTCAAGAACAGCTTCTGTCCTTCTTCATGGAAGACGTTTTTGGTCAACTGCAATTGCAAGGCTGCAAGAAAATACGCTTTGTGGAGGACTTTCATAGCCTTAGGCAGAAATTGAGCCACTGTATTTCCTGTGCTTCATCAGCTAGAGAGATGAAATCCATTACCAGGATGAAAAGAATATTTTATAGGATTGGAAACAAAGGAATCTACAAAGCCATCAGTGAACTGGATATTCTTCTTTCCTGGATTAAAAAATTATTGGAAAGCAGTCAGTAAACCAAAGCCAAGTACATTGATTTTACAGTTATTTTGAAATACAATAAGAACTGCTAGAAATATGTTTATAACAGTCTATTTCTTTTAAAAACTTTTTAACATAATACTGACGGCATGTTAGGTGATTCAGAATAGACAAGAAGGATTTAGTAAATTAACGTTTTGGATATAAGTTGTCACTAATTTGCACATTTTCTGTGTTTTCAAATAATGTTTCCATTCTGAACATGTTTTGTCATTCACAAGTACATTGTGTCAACTTAATTTAAAGTATGTAACCTGAATTAACTCGTGTAATATTTGTGTGTGGAGTGGGATGTGGGGGGTGGAGGGGGAATGACAGATTTCTGGAATGCAATGTAATGTTACTGAGACTTAAATAGATGTTATGTATATGATTGTCTGTTTAAGTGTTTGAAAATTGTTAATTATGCCCAGTGTGAACTTAGTACTTAACACATTTTGATTTTAATTAAATAAATTGGGTTTCCTTCTCAAAAAAAAAAAAAAAAAAAAAAAAAAAAA

SEQ ID NO: 220 - protein, 171 aa, Homo Sapien
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 221 - DNA, 1129 bp, Homo Sapien
gaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagctgaaaaaaaaaaaaaaaaaaa

SEQ ID NO: 222 - protein, 290 aa, Homo Sapien
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 223 - DNA, 1661 bp, Homo Sapien
caagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggagttgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcca

SEQ ID NO: 224 - protein, 449 aa, Homo Sapien
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGVAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 225 - DNA, 1971 bp, Homo Sapien
ggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccagagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaggaaaaaaaaaaaaaaaaaaaaaaaaaaaaaaaaaaaaaaaaaa

SEQ ID NO: 226 - protein, 441 aa, Homo Sapien
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 227 - DNA, 840 bp, Homo Sapien
ggcacgaggtggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaaccttctacatgttggctgcccccttcccctatttcagcagtgcccagtcctgcttataaacctgaggcctgctccccataccttccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctaggactaa

SEQ ID NO: 228 - protein, 120 aa, Homo Sapien [sequence omitted]

SEQ ID NO: 229 - DNA, 2837 bp, Homo Sapien
gggaagggatgcaaggaagccctccggcgctgcgctccgaggcgggagacagcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtaaaaaaaaaaa

SEQ ID NO: 230 - protein, 677 aa, Homo Sapien
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 231 - DNA, 1058 bp, Homo Sapien
gagaaaaacaacaggaagcagcttacaaactcggtgaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggctaaaaaaaaaaaaa

SEQ ID NO: 232 - protein, 189 aa, Homo Sapien
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 233 - DNA, 4333 bp, Homo Sapien
cccacgcgtccggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaccaaaaaaaaaaaaa

SEQ ID NO: 234 - protein, 1160 aa, Homo Sapien
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKVPPRDIEEGNVKMLGMQIPIKNVEMLASVLVAISVTLLLVVLALGGVVWYQHRQRKLRRNRRSILDDSFKLLSFKQ

SEQ ID NO: 235 - DNA, 3442 bp, Homo Sapien
ggaaagagtgctggtactacaaccaggaagtgacagataatgtgctttaaactacattagaaaagcttctcatagcaaaactgagagattgaagcagtgattatttttacatagttgtcattaaatatttggagctctgctgtgcatagagatggcaacatacttagaatacacagctttctgggccagaaattgatcttctgacttttgagccttatctgattactgcttggttcatctttattttgttaaactactctgtaggctgaaagggagagactctccttggtttgcagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttaattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttcaaaa

SEQ ID NO: 236 - protein, 457 aa, Homo Sapien
MENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 237 - DNA, 762 bp, Homo Sapien
caggggctggagggcaggggaggggatgatgtcattcctgctcggcgcaatcctgaccctgctctgggcgcccacggctcaggctgaggttctgctgcagcctgacttcaatgctgaaaagttctcaggcctctggtacgtggtctccatggcatctgactgcagggtcttcctgggcaagaaggaccacctgtccatgtccaccagggccatcaggcccacagaggagggcggcctccacgtccacatggagttcccgggggcggacggctgtaaccaggtggatgccgagtacctgaaggtgggctccgagggacacttcagagtcccggccttgggctacctggacgtgcgcatcgtggacacagactacagctccttcgccgtcctttacatctacaaggagctggagggggccctcagcaccatggtgcagctctacagccggacccaggatgtgagtccccaggctctgaagtccttccaggacttctacccgaccctggggctccccaaggacatgatggtcatgctgccccagtcagatgcatgcaaccctgagagcaaggaggcgccctgacacctccggagccccacccccgcccttcccaggtggagccaaagcagcaggcgcctttgcccctggagtcaagacccacagccctcggggaccacctggagtctctccatcctccaccccccgcctgtgggatgccttgtgggacgtctctttctattcaataaacagatgctgcagcctca

SEQ ID NO: 238 - protein, 184 aa, Homo Sapien
MMSFLLGAILTLLWAPTAQAEVLLQPDFNAEKFSGLWYVVSMASDCRVFLGKKDHLSMSTRAIRPTEEGGLHVHMEFPGADGCNQVDAEYLKVGSEGHFRVPALGYLDVRIVDTDYSSFAVLYIYKELEGALSTMVQLYSRTQDVSPQALKSFQDFYPTLGLPKDMMVMLPQSDACNPESKEAP

SEQ ID NO: 239 - DNA, 1656 bp, Homo Sapien
ggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaaaaaaaaaaaaaaaaaaaaaaaaaaa

SEQ ID NO: 240 - protein, 189 aa, Homo Sapien
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 241 - DNA, 1319 bp, Homo Sapien
gattccgagcgcctccactgctggtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgttaa

SEQ ID NO: 242 - protein, 284 aa, Homo Sapien
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 243 - DNA, 1837 bp, Homo Sapien
cttgtctttgtgtcggttgtgattttcctaatctctgattttccttttctctcggacgctctccctcttcggacccattttctcccgtgcttcatgccctgatagcctggccccttcccggcttccttcgctaccggggacgcctctagtttttctgaatttctggctggctccaccctccgcgttcatcttcctcaagagttcgcccctctgggggctcctctgtgtaatcgtcgccttctctgggtatttctgtgaactccgtctcacaccatcccgccatcttctctgccttggccccttttctctgtacagccagctctgtgtccttttcttctccccctctaaaatcgactcctcttctccctgagagccccacctttgtgccccactcctcattttcctacgcctccctctctctgctggtcctctctctccctgcaaggttccattccatcaatttgtttgtcttttgtaggggtggcatcccctctgactactgctccatccttttttttttttttttttttttttttgcttgaggatttcacttcaatcttttctggttgcgtctccacttgtactcagcttgttaggtccaggtccagttgttctgcatctgaggctggcgtgtgctgtcttctctgattggcctaatctccctcacccccgtgagatctgttgtcagccttcgtttctctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatccccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttcccttaaaaaaaaaaaaaaaaaaaaaaaaaaaaaaaaaaaaaaaaaaaa

SEQ ID NO: 244 - protein, 246 aa, Homo Sapien
MGPQHLRLVQLFCLLGAIPTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 245 - DNA, 2594 bp, Homo Sapien
gtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttataaaaaaa

SEQ ID NO: 246 - protein, 523 aa, Homo Sapien
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 247 - DNA, 1123 bp, Homo Sapien
cgtctgtagagatatcatgaacttcaacttagctttggtactttcttccctgaagacagagggcagaactctgagttccagaaccattttcaactgtattggggaccaatcacttgactctattcttgtctctctgacagatgacgctacactctcctctgaataatggacaccatttctaaaactgaatcctgctactaaaataattcagatgatatatttttccaattctacaatcttgctttgttttatttagttgttttctctctctcttcccagttttccagagactggagctaaactgggctttcaacatcatcatgaagtttatcctcctctgggccctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctc

SEQ ID NO: 248 - protein, 241 aa, Homo Sapien
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 249 - DNA, 526 bp, Homo Sapien
gcgaggcggccgctgtcttctgctgcggcttccgcgaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccataccatcaa

SEQ ID NO: 250 - protein, 134 aa, Homo Sapien
MWWLSIGALIGLSVAAVVLLAFIVTACVLCYLFISSKPHTKLDLGLSLQTAGPEEVSPDCQGVNTGMAAEVPKVSPLQQSYSCLNPQLESNEGQAVNSKRLLHHCFMATVTTSDIPGSPEEASVPNPDLCGPVP

SEQ ID NO: 251 - DNA, 1714 bp, Homo Sapien
gtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaaaaaaaaaaaaaaaaaaaaaaaaaaaaaaaaaaaa

SEQ ID NO: 252 - protein, 361 aa, Homo Sapien
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 253 - DNA, 2016 bp, Homo Sapien
gatcaagcgccttcctttcccttcctctccctacttggcctttgccctaagccaagacctggccatcagcctggctgcaggggcctgcagagccagctgcactttttcaggtatgggggagggccaggcaccatgaagccagtgtgggtcgccacccttctgtggatgctactgctggtgcccaggctgggggccgcccggaaggggtccccagaagaggcctccttctactatggaaccttccctcttggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaaacctggcattcttataacaccacgtggcgcagcaagcagcaaggtctggtgggaatttcactgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcctttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaatta

SEQ ID NO: 254 - protein, 567 aa, Homo Sapien
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKTWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 255 - DNA, 1432 bp, Homo Sapien
cgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattatattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatgaa

SEQ ID NO: 256 - protein, 341 aa, Homo Sapien
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 257 - DNA, 1606 bp, Homo Sapien; identical to SEQ ID NO: 65

SEQ ID NO: 258 - protein, 406 aa, Homo Sapien [sequence omitted]

SEQ ID NO: 259 - DNA, 2024 bp, Homo Sapien
caggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 260 - protein, 420 aa, Homo Sapien
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 261 - DNA, 882 bp, Homo Sapien
gcgtggtgcgggggcgtggggaaatcgggttgccccagccgttactggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgcaagaggagaatcttgctctctctgctcaaaagaagagaaatgtgtaaagaacctctgcaggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaata

SEQ ID NO: 262 - protein, 242 aa, Homo Sapien [sequence omitted]

SEQ ID NO: 263 - DNA, 1687 bp, Homo Sapien
  unsure 1447, 1489, 1593: unknown base
cgccctccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggcaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtnttatggagatggcaagaaaggaggaaatgatttcttcagatntcaaaggagtctgaaatatcatatttctgtgtgtgtctctctcagcccctgcccaggctagagggaaacagctactgataatcgaaaactgctgtttgtggcangaacccctggctgtgcaaataaatggggctgaggcccctgtgtgatattgaaaaaaaaaaaaaaaaaaaaaaaaaaaaaaaaaaaaaaaaaaga

SEQ ID NO: 264 - protein, 305 aa, Homo Sapien
MGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 265 - DNA, 996 bp, Homo Sapien
cccgtgccaagagtgacgtaagtaccgcctatagagtctataggcccacttggcttcgttagaacgcggctacaattaatacataaccttatgtatcatacacatacgatttaggtgacactatagaataacatccactttgcctttctctccacaggtgtccactcccaggtccaactgcacctcggttctatcgataatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctgg

SEQ ID NO: 266 - protein, 251 aa, Homo Sapien
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 267 - DNA, 2290 bp, Homo Sapien
ggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaaaaa

SEQ ID NO: 268 - protein, 493 aa, Homo Sapien
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 269 - DNA, 1869 bp, Homo Sapien
gccgagctgagcggatcctcacatgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacac

SEQ ID NO: 270 - protein, 453 aa, Homo Sapien [sequence omitted]

SEQ ID NO: 271 - DNA, 1174 bp, Homo Sapien
cggacgcgtgggggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtg

SEQ ID NO: 272 - protein, 323 aa, Homo Sapien
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 273 - DNA, 1200 bp, Homo Sapien
cccacgcgtccgaacctctccagcgatgggagccgcccgcctgctgcccaacctcactctgtgcttacagctgctgattctctgctgtcaaactcagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgc

SEQ ID NO: 274 - protein, 205 aa, Homo Sapien
MGAARLLPNLTLCLQLLILCCQTQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 275 - DNA, 715 bp, Homo Sapien
tatttaccatatcagattcacattcagtcctcagcaaaatgaagggctccattttcactctgtttttattctctgtcctatttgccatctcagaagtgcggagcaaggagtctgtgagactctgtgggctagaatacatacggacagtcatctatatctgtgctagctccaggtggagaaggcatctggaggggatccctcaagctcagcaagctgagacaggaaactccttccagctcccacataaacgtgagttttctgaggaaaatccagcgcaaaaccttccgaaggtggatgcctcaggggaagaccgtctttggggtggacagatgcccactgaagagctttggaagtcaaagaagcattcagtgatgtcaagacaagatttacaaactttgtgttgcactgatggctgttccatgactgatttgagtgctctttgctaagacaagagcaaatacccaatgggtggcagagctttatcacatgtttaattacagtgttttactgcctggtagaacactaatattgtgttattaaaatgatggcttttgggtaggcaaaacttcttttctaaaaggtatagctgagcggttgaaaccacagtgatctctattttctccctttgccaaggttaatgaactgttcttttcaaattctactaatgctttgaaatttcaaatgctgcgcaaaattgcaataaaaatgctataaa

SEQ ID NO: 276 - protein, 135 aa, Homo Sapien
MKGSIFTLFLFSVLFAISEVRSKESVRLCGLEYIRTVIYICASSRWRRHLEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 277 - DNA, 3355 bp, Homo Sapien
gcagctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtctcagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacagaaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatattttttaaatttcagccaaataatgcattttattttataaaaatacagacagaaaattagggagaaacttctagttttgccaatagaaaatgttcttccattgaataaaagttatttcaaattgaatttgtgcctttcacacgtaatgattaaatctgaattcttaataatatatcctatgctgattttcccaaaacatgacccatagtattaaatacatatcatttttaaaaataaaaaaaaacccaaaaataatgcatgcataatttaaatggtcaatttataaagacaaatctatgaatgaatttttcagtgttatcttcatatgatatgctgaacaccaaaatctccagaaatgcattttatgtagttctaaaatcagcaaaatattggtattacaaaaatgcagaatatttagtgtgctacagatctgaattatagttctaatttattattactttttttctaatttactgatcttactactacaaagaaaaaaaaacccaacccatctgcaattcaaatcagaaagtttggacagctttacaagtattagtgcatgctcagaacaggtgggactaaaacaaactcaaggaactgttggctgttttcccgatactgagaattcaacagctccagagcagaagccacaggggcatagcttagtccaaactgctaatttcattttacagtgtatgtaacgcttagtctcacagtgtctttaactcatctttgcaatcaacaactttactagtgactttctggaacaatttcctttcaggaatacatattcactgcttagaggtgaccttgccttaatatatttgtgaagttaaaattttaaagatagctcatgaaacttttgcttaagcaaaaagaaaacctcgaattgaaatgtgtgaggcaaactatgcatgggaatagcttaatgtgaagataatcatttggacaactcaaatccatcaacatgaccaatgtttttcatctgccacatctcaaaataaaacttctggtgaaacaaattaaacaaaatatccaaacctcaaaaaaaa

SEQ ID NO: 278 - protein, 491 aa, Homo Sapien
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 279 - DNA, 1231 bp, Homo Sapien
cccacgcgtccgcgcagtcgcgcagttctgcctccgcctgccagtctcgcccgcgatcccggcccggggctgtggcgtcgactccgacccaggcagccagcagcccgcgcgggagccggaccgccgccggaggagctcggacggcatgctgagccccctcctttgctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagc

SEQ ID NO: 280 - protein, 245 aa, Homo Sapien
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 281 - DNA, 1471 bp, Homo Sapien
ccaggatggagctggggcctgtatagccatattattgttctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgaggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgt

SEQ ID NO: 282 - protein, 225 aa, Homo Sapien
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 283 - DNA, 744 bp, Homo Sapien
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatag

SEQ ID NO: 284 - protein, 247 aa, Homo Sapien
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 285 - DNA, 2849 bp, Homo Sapien
  unsure 2715: unknown base
cggacgcgtgggcggacgcgtgggcggacgcgtgggcggacgcgtgggctggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcatgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatngtgcctaggttatgtggtgactatttgaatcaaaaatgtattgaatcatcaaataaaagaatgtggctattttggggagaaaattaaaaaaaaaaaaaaaaaaaaaggtttagggataacagggtaatgcggcc

SEQ ID NO: 286 - protein, 345 aa, Homo Sapien
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 287 - DNA, 1496 bp, Homo Sapien
cagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgcccccttcaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgg

SEQ ID NO: 288 - protein, 204 aa, Homo Sapien
MEFLWAPLLGLCCSLAAADRHTVFWNSSNPKFRNEDYTIHVQLNDYVDIICPHYEDHSADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 289 - DNA, 1838 bp, Homo Sapien
cggacgcgtgggcggacgcgtgggcggcccacggcgcccgcgggctggggcggtcgcttcttccttctccgtggcctacgagggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaaaaaa

SEQ ID NO: 290 - protein, 420 aa, Homo Sapien
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 291 - DNA, 2447 bp, Homo Sapien
caggtccaactgcacctcggttctatcgattgaattccccggggatcctctagagatccctcgacctcgacccacgcgtccgaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacaccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccaaaaaaaaaaaaaaaaaagggcggccgcgactctagagtcgacct

SEQ ID NO: 292 - protein, 428 aa, Homo Sapien
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 293 - DNA, 3449 bp, Homo Sapien
acttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcag

SEQ ID NO: 294 - protein, 915 aa, Homo Sapien [sequence omitted]

SEQ ID NO: 295 - DNA, 1364 bp, Homo Sapien
ggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggaaaaaaaaa

SEQ ID NO: 296 - protein, 353 aa, Homo Sapien
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 297 - DNA, 2639 bp, Homo Sapien
gacatcggaggtgggctagcactgaaactgcttttcaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaac

SEQ ID NO: 298 - protein, 708 aa, Homo Sapien
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 299 - DNA, 1102 bp, Homo Sapien
gctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccagggactcctgccccagctgctgaagagacaatgaccaccagcccggggactcctgccccagctgctgaagagacaatgaccaccagcccggggactcctgccccagctgctgaagagacaatgaccaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgc

SEQ ID NO: 300 - protein, 259 aa, Homo Sapien
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMTTSPGTPASSHYLSCTIVGIIVLIVLLIVFV

SEQ ID NO: 301 - DNA, 1576 bp, Homo Sapien
cacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaaccta

SEQ ID NO: 302 - protein, 421 aa, Homo Sapien
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 303 - DNA, 1305 bp, Homo Sapien
gcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagttttttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgggaaaaaaaaaaaaaaaaaaaaaaaaca

SEQ ID NO: 304 - protein, 259 aa, Homo Sapien
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 305 - DNA, 2822 bp, Homo Sapien
cgccaccactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaaaaaaaaggtttacctccacaaattgaaaaaaaaaaaaaaaaaaaaaaaaaaaaaaaaaaaaaaaaaaaaaaaa

SEQ ID NO: 306 - protein, 690 aa, Homo Sapien [sequence omitted]

SEQ ID NO: 307 - DNA, 2033 bp, Homo Sapien
ccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttttggaaaaaaaaaaaaaaaaaaaaaaaaa

SEQ ID NO: 308 - protein, 379 aa, Homo Sapien
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 309 - DNA, 1843 bp, Homo Sapien
  unsure 1837: unknown base
cccacgcgtccggtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatccatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagnaaaaaa

SEQ ID NO: 310 - protein, 490 aa, Homo Sapien
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIHHAHWVLFLRN

SEQ ID NO: 311 - DNA, 1210 bp, Homo Sapien
cagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagttcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactccctgctgccccgtctgagggtggcgattaaagttgcttc

SEQ ID NO: 312 - protein, 282 aa, Homo Sapien
MSGGWMAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 313 - DNA, 2197 bp, Homo Sapien
cggacgcgtgggcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcatggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccaataccccaccccaatcccgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtttcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataaaaaaaaa

SEQ ID NO: 314 - protein, 164 aa, Homo Sapien
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWHGGSRHDQSHQPGQLWLAGWEPQRLLGHDPG

SEQ ID NO: 315 - DNA, 1024 bp, Homo Sapien
cggacgcgtgggcccctggtgggcccagcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttca

SEQ ID NO: 316 - protein, 288 aa, Homo Sapien
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 317 - DNA, 1875 bp, Homo Sapien
cccaagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacatggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcgtcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggtgggcgggtcacactgcaggaagcctcaggctggggcagggtggcacttgggggggcaggccaagttcacctaaatgggggtctctatatgttcaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggaaaaaaaaaaaa

SEQ ID NO: 318 - protein, 443 aa, Homo Sapien
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCVNEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 319 - DNA, 1266 bp, Homo Sapien
gctggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 320 - protein, 250 aa, Homo Sapien
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 321 - DNA, 783 bp, Homo Sapien
agaacctcagaaatgtgagttatttgggaatggctgtttgtaaatgtccttacgtaagccaagaggaggtcttgacttggggtcccaggggtaccgcagatcccagggactggagcagcactagcaagctctggaggatgagccaggagtctggaattgaggctgagccaaagaccccagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttgaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 322 - protein, 94 aa, Homo Sapien
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 323 - DNA, 2290 bp, Homo Sapien
accgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagtgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagcaggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggtcgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactaaaaaaaaaaaaaaaaaaaaaa

SEQ ID NO: 324 - protein, 620 aa, Homo Sapien [sequence omitted]

SEQ ID NO: 325 - DNA, 1670 bp, Homo Sapien
cccacgcgtccgcccacgcgtccgagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgtgggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatactta

SEQ ID NO: 326 - protein, 328 aa, Homo Sapien
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 327 - DNA, 2454 bp, Homo Sapien
ggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataaggggttgagagaaacaagcatctattgcagtttcctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaat

SEQ ID NO: 328 - protein, 379 aa, Homo Sapien
MKEYVLLLFLALCSAKPFFSPSHIALKNMMLKDMEDTDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 329 - DNA, 1514 bp, Homo Sapien
ggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaatg

SEQ ID NO: 330 - protein, 428 aa, Homo Sapien
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 331 - DNA, 2477 bp, Homo Sapien
cgagggcttttccggctccggaatggcacatgtgggaatcccagtcttgttggctacaacatttttccctttcctaacaagttctaacagctgttctaacagctagtgatcaggggttcttcttgctggagaagaaagggctgagggcagagcagggcactctcactcagggtgaccagctccttgcctctctgtggataacagagcatgagaaagtgaagagatgcagcggagtgaggtgatggaagtctaaaataggaaggaattttgtgtgcaatatcagactctgggagcagttgacctggagagcctgggggagggcctgcctaacaagctttcaaaaaacaggagcgacttccactgggctgggataagacgtgccggtaggatagggaagactgggtttagtcctaatatcaaattgactggctgggtgaacttcaacagccttttaacctctctgggagatgaaaacgatggcttaaggggccagaaatagagatgctttgtaaaataaaattttaaaaaaagcaagtattttatagcataaaggctagagaccaaaatagataacaggattccctgaacattcctaagagggagaaagtatgttaaaaatagaaaaaccaaaatgcagaaggaggagactcacagagctaaaccaggatggggaccctgggtcaggccagcctctttgctcctcccggaaattatttttggtctgaccactctgccttgtgttttgcagaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtctcgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggagcgcctgcagtcctgctaccagggcgagggcaacctggagctcaactggctgctggggaaggacgtccagtgcacgaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaaggtaagagtctatgagttcagatgctccaatgccattcacctcctcagcaaagagtccctcttggaaggtagctattggtggagatttaactataggcaactttattttcttggggaacaaaggtgaaatggggaggtaagaaggggttaattttgtgacttagcttctagctacttcctccagccatcagtcattgggtatgtaaggaatgcaagcgtatttcaatatttcccaaactttaagaaaaaactttaagaaggtacatctgcaaaagcaaa

SEQ ID NO: 332 - protein, 552 aa, Homo Sapien [sequence omitted]

SEQ ID NO: 333 - DNA, 1520 bp, Homo Sapien
gctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatag

SEQ ID NO: 334 - protein, 433 aa, Homo Sapien
MPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 335 - DNA, 1295 bp, Homo Sapien
cccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattc

SEQ ID NO: 336 - protein, 312 aa, Homo Sapien
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENVQWLTPVIPALWKAAAGGSRGQEF

SEQ ID NO: 337 - DNA, 1813 bp, Homo Sapien
ggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgaaaaa

SEQ ID NO: 338 - protein, 390 aa, Homo Sapien
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 339 - DNA, 3552 bp, Homo Sapien
gcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagtcgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctctactggtgtgtgcatttaatgacatctaactacagatgccgcacagccacaatgctttgccttatagttttttaactttagaacgggattatcttgttattacctgtattttcagtttcggatatttttgacttaatgatgagattatcaagacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacgggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatrttaaaaaaaaaaaaaaaaaaaaaaaaaaaaaaa

SEQ ID NO: 340 - protein, 386 aa, Homo Sapien
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVESPEEPQRLLEQAEAEGCQRRRLLVPVNDADSADISTLLDASATLEEGHAKETIQDQLVGSEKLFYEEDEAGSATSCL

SEQ ID NO: 341 - DNA, 1252 bp, Homo Sapien
gcctctgaattgttgggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtc

SEQ ID NO: 342 - protein, 364 aa, Homo Sapien
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 343 - DNA, 2917 bp, Homo Sapien
cccacgcgtccggccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtaaaaaaa

SEQ ID NO: 344 - protein, 607 aa, Homo Sapien
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 345 - DNA, 2933 bp, Homo Sapien
tgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaattgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaaaaaaaaaaaaaaaaaaaaaaaaaaaaaaaaaaaaaaaaaaaaaaaaaaaaaaaaa

SEQ ID NO: 346 - protein, 723 aa, Homo Sapien
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 347 - DNA, 1685 bp, Homo Sapien
cccacgcgtccgcacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaaca

SEQ ID NO: 348 - protein, 398 aa, Homo Sapien
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 349 - DNA, 2479 bp, Homo Sapien
acttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaaccgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatctt

SEQ ID NO: 350 - protein, 660 aa, Homo Sapien
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 351 - DNA, 4053 bp, Homo Sapien
agccgacgctgctcaagctgcaactctgttgcagttggcagttcttttcggtttccctcctgctgtttgggggcatgaaagggcttcgccgccgggagtaaaagaaggaattgaccgggcagcgcgagggaggagcgcgcacgcgaccgcgagggcgggcgtgcaccctcggctggaagtttgtgccgggccccgagcgcgcgccggctgggagcttcgggtagagacctaggccgctggaccgcgatgagcgcgccgagcctccgtgcgcgcgccgcggggttggggctgctgctgtgcgcggtgctggggcgcgctggccggtccgacagcggcggtcgcggggaactcgggcagccctctggggtagccgccgagcgcccatgccccactacctgccgctgcctcggggacctgctggactgcagtcgtaagcggctagcgcgtcttcccgagccactcccgtcctgggtcgctcggctggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgaaaaaaaaaaaaaaaaaaaaaaaaaaaaaaa

SEQ ID NO: 352 - protein, 1119 aa, Homo Sapien
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 353 - DNA, 2755 bp, Homo Sapien
gggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgac

SEQ ID NO: 354 - protein, 696 aa, Homo Sapien
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 355 - DNA, 2226 bp, Homo Sapien
agtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgat

SEQ ID NO: 356 - protein, 490 aa, Homo Sapien
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 357 - DNA, 3283 bp, Homo Sapien
cccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggc

SEQ ID NO: 358 - protein, 1049 aa, Homo Sapien
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 359 - DNA, 1875 bp, Homo Sapien
gacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgttgtgtcagggctgaactcgggccctggtcatgtgtggggccctctcctgggactactgctcctgcctcctctggtgttggctggaatcttctgaatgggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtgaaa

SEQ ID NO: 360 - protein, 463 aa, Homo Sapien
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEGPDKPSVVSGLNSGPGHVWGPLLGLLLLPPLVLAGIF

SEQ ID NO: 361 - DNA, 1377 bp, Homo Sapien
gactagttctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctcataaaaaaaaaaaaaaaaaaaaaaaaaaaa

SEQ ID NO: 362 - protein, 243 aa, Homo Sapien
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 363 - DNA, 1503 bp, Homo Sapien
ggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaccttgaaaaaaaaaaaaaaaaaaaaaaaaaaaaaaaaaaaaaaaaaaaaaaaaaaaaaaaaa

SEQ ID NO: 364 - protein, 328 aa, Homo Sapien
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 365 - DNA, 1857 bp, Homo Sapien
gtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctgtaatcccagaggctgaggcaggcggatcacctgaggtcgggagttcgggatcagcctgaccaacatggagaaaccctactggaaatacaaagttagccaggcatggtggtgcatgcctgtagtcccagctgctcaggagcctggcaacaagagcaaaactccagctcaaaaaaaaaaaaaaaa

SEQ ID NO: 366 - protein, 299 aa, Homo Sapien
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 367 - DNA, 2906 bp, Homo Sapien
ggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccacccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcctttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctccttttttttaaatttttattccttttggtatcaagatcatgcgttttctcttgttcttaaccacctggatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgaggcacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagacaaaaa

SEQ ID NO: 368 - protein, 640 aa, Homo Sapien
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 369 - DNA, 3296 bp, Homo Sapien
caaaacttgcgtcgcggagagcgcccagcttgacttgaatggaaggagcccgagcccgcggagcgcagctgagactgggggagcgcgttcggcctgtggggcgccgctcggcgccggggcgcagcagggaaggggaagctgtggtctgccctgctccacgaggcgccactggtgtgaaccgggagagcccctgggtggtcccgtcccctatccctcctttatatagaaaccttccacactgggaaggcagcggcgaggcaggagggctcatggtgagcaaggaggccggctgatctgcaggcgcacagcattccgagtttacagatttttacagataccaaatggaaggcgaggaggcagaacagcctgcctggttccatcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacactgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcaaaaaaaaaa

SEQ ID NO: 370 - protein, 642 aa, Homo Sapien [sequence omitted]

SEQ ID NO: 371 - DNA, 2849 bp, Homo Sapien
cactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctccttggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcaa

SEQ ID NO: 372 - protein, 281 aa, Homo Sapien
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 373 - DNA, 1572 bp, Homo Sapien
cggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttccaatggatttgccttctcaaaatgtacaactaagcaactaaagaaaattaaagtgaaagttgaaaaat

SEQ ID NO: 374 - protein, 318 aa, Homo Sapien
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 375 - DNA, 1679 bp, Homo Sapien
gttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaaaaaaaaa

SEQ ID NO: 376 - protein, 344 aa, Homo Sapien
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 377 - DNA, 2110 bp, Homo Sapien
cttctttgaaaaggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggattccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaggaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgcttttaaaaaaaaaaaaaa

SEQ ID NO: 378 - protein, 450 aa, Homo Sapien
MWLKVFTTFLSFATGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 379 - DNA, 823 bp, Homo Sapien
atagtagaagaatgtctctgaaattactggatgagtttcagtcatactttcacatgggcacaatttcacattcaagctccttatcctaggctaattttatattatgttaaatcacttgtttttgttctcacggcttcctgcctgctataggcataattacgaggaagcagaacttctccagaagcaagcgcacatgcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagctcgggaggtggccaggcggcaggaaggcgcacccccccagcaatccgcgcgccgggacagaatgccctgcaggaacttcttctggaagaccttctcctcctgcaaatag

SEQ ID NO: 380 - protein, 155 aa, Homo Sapien
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 381 - DNA, 2236 bp, Homo Sapien
ggcgccggtgcaccgggcgggctgagcgcctcctgcggcccggcctgcgcgccccggcccgccgcgccgcccacgccccaaccccggcccgcgccccctagcccccgcccgggcccgcgcccgcgcccgcgcccaggtgagcgctccgcccgccgcgaggccccgccccggcccgcccccgccccgccccggccggcgggggaaccgggcggattcctcgcgcgtcaaaccacctgatcccataaaacattcatcctcccggcggcccgcgctgcgagcgccccgccagtccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaa

SEQ ID NO: 382 - protein, 473 aa, Homo Sapien
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 383 - DNA, 2336 bp, Homo Sapien
  unsure 1620, 1673: unknown base
ttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaagtagcccggcgtggtgatgcgtgcctgtaatcccagctacccaggaaggctgaggcggcagaatcacttgaacccgaggccgaggttgcggtaagccgagatcacctncagcctggacactctgtctcgaaaaaagaaaagaacacggttaataccatatnaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctcaaaaaaaaaaaaaagaagcagacctacagcagctactattgaataaatacctatcctggatttt

SEQ ID NO: 384 - protein, 211 aa, Homo Sapien
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 385 - DNA, 2749 bp, Homo Sapien
  unsure 1869, 1887: unknown base
ctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctggctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatccagcccttcaggaagcctgtgaaaaacgtgattcctggccccaccaagacccaccaaaaccatctctgggcttggtgcaggactctgaattctaacaatgcccagtgactgtcgcacttgagtttgagggccagtgggcctgatgaacgctcacaccccttcagcttagagtctgcatttgggctgtgacgtctccacctgccccaatagatctgctctgtctgcgacaccagatccacgtggggactcccctgaggcctgctaagtccaggccttggtcaggtcaggtgcacattgcaggataagcccaggaccggcacagaagtggttgcctttnccatttgccctccctggnccatgccttcttgcctttggaaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtggtggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcataaaaaaaaaaaaaa

SEQ ID NO: 386 - protein, 332 aa, Homo Sapien [sequence omitted]

SEQ ID NO: 387 - DNA, 2458 bp, Homo Sapien
gcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccgagattatgccattgcactccagcctgggtgacagagcgggactccgtctc

SEQ ID NO: 388 - protein, 373 aa, Homo Sapien
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 389 - DNA, 963 bp, Homo Sapien
gcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaaaaaaaaa

SEQ ID NO: 390 - protein, 235 aa, Homo Sapien
MRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 391 - DNA, 3772 bp, Homo Sapien
gggggctttcttgggcttggctgcttggaacacctgcctccaaggaccggcctcggaggggtcgccgggaaagggagggaagaaggaagggcggggccggcccccctgcgcccgccccgcgcctctgcgcgcccctgtccgccccggcccagcccagcccagccccgcgggccggtcacacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtatccctacgacctggtgcggtccccctggaagacgcaggaacacacccccacccccgatgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacccttaaaaaaaaaaaaaaaaaaaaaaaaaaaaaaaaaaaaaaaaaaaaaaaa

SEQ ID NO: 392 - protein, 756 aa, Homo Sapien
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGRKRRQRG

SEQ ID NO: 393 - DNA, 4313 bp, Homo Sapien
gtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcaatggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccgaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtaaaaaaaaaaaaaaaaaaaa

SEQ ID NO: 394 - protein, 1184 aa, Homo Sapien [sequence omitted]

SEQ ID NO: 395 - DNA, 999 bp, Homo Sapien
cccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 396 - protein, 260 aa, Homo Sapien
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 397 - DNA, 1312 bp, Homo Sapien
ggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctggaaaaaaaaaaaaaaaaa

SEQ ID NO: 398 - protein, 313 aa, Homo Sapien
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 399 - DNA, 1510 bp, Homo Sapien
ggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccctaataaaaaaaaaaaaaaaaaaaaaaaaaaaaaaaaaaaaaaaaaaaaaaaaaaaaaaaaa

SEQ ID NO: 400 - protein, 354 aa, Homo Sapien
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 401 - DNA, 584 bp, Homo Sapien
cttcccagccctgtgccccaaagcacctggagcatatagccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaac

SEQ ID NO: 402 - protein, 123 aa, Homo Sapien
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 403 - DNA, 1964 bp, Homo Sapien
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataaatttttcacgagaacaaactttgtaaatcttccataagcaaaatgacagctagtgcttgggatcgtacatgttaattttttgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatgactccaaaaaaaaaaaaaaa

SEQ ID NO: 404 - protein, 436 aa, Homo Sapien
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 405 - DNA, 3819 bp, Homo Sapien
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcgcctagcaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 406 - protein, 693 aa, Homo Sapien
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 407 - DNA, 950 bp, Homo Sapien
ttgtgactaaaagctggcctagcaggccagggagtgcagctgcaggcgtgggggtggcaggagccgcagagccagagcagacagccgagaaacaggtggacagtgtgaaagaaccagtggtctcgctctgttgcccaggctagagtgtactggcgtgatcatagctcactgcagcctcagactcctggacttgagaaatcctcctgccttagcctcctgcatatctgggactccaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaaa

SEQ ID NO: 408 - protein, 146 aa, Homo Sapien
MLLALVCLLSCLLPSSEAKLYGRCELARVLHDFGLDGYRGYSLADWVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 409 - DNA, 3617 bp, Homo Sapien
cagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaagattctttatgtgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaaggaaaa

SEQ ID NO: 410 - protein, 229 aa, Homo Sapien
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 411 - DNA, 4420 bp, Homo Sapien
cccagctgaggagccctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacatggttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcacagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaagagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcggacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagggtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcgaaaaaa

SEQ ID NO: 412 - protein, 1184 aa, Homo Sapien [sequence omitted]

SEQ ID NO: 413 - DNA, 595 bp, Homo Sapien
gccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctcaaaaaaaaaaaaaaaaaaaaa

SEQ ID NO: 414 - protein, 111 aa, Homo Sapien
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 415 - DNA, 1621 bp, Homo Sapien
cagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttta

SEQ ID NO: 416 - protein, 358 aa, Homo Sapien
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 417 - DNA, 1547 bp, Homo Sapien
cggcggcggctgcgggcgcgaggtgaggggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacga

SEQ ID NO: 418 - protein, 414 aa, Homo Sapien
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 419 - DNA, 1781 bp, Homo Sapien
ggcacgaggctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaaaaaaa

SEQ ID NO: 420 - protein, 378 aa, Homo Sapien
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 421 - DNA, 1355 bp, Homo Sapien
cggacgcgtgggcggacgcgtgggcggacgcgtgggcggacgcgtgggctgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggctcctggagctgattgccaaagagtttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaaaaaa

SEQ ID NO: 422 - protein, 293 aa, Homo Sapien
MDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 423 - DNA, 2368 bp, Homo Sapien
gcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagcatctctggcaagatatggcatcttcacaactatttcacagtgactcttggaattcctgcttggtgttcttatgtgtttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttcttt

SEQ ID NO: 424 - protein, 349 aa, Homo Sapien
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 425 - DNA, 4040 bp, Homo Sapien
gaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagtctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaaaaaaaaaaaaaa

SEQ ID NO: 426 - protein, 747 aa, Homo Sapien [sequence omitted]

SEQ ID NO: 427 - DNA, 1518 bp, Homo Sapien
ctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaaaaaaaaaaaaa

SEQ ID NO: 428 - protein, 266 aa, Homo Sapien
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 429 - DNA, 1523 bp, Homo Sapien
gagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgctacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttaaaaaaaaaaaaaaaaaaaaaaaaaaaaaaaaaaaaaaaaaaaaa

SEQ ID NO: 430 - protein, 406 aa, Homo Sapien [sequence omitted]

SEQ ID NO: 431 - DNA, 1575 bp, Homo Sapien
gagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggggggcccggtacccaattcgccctatagtgagtcgta

SEQ ID NO: 432 - protein, 346 aa, Homo Sapien [sequence omitted]

SEQ ID NO: 433 - DNA, 1657 bp, Homo Sapien
cgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcct

SEQ ID NO: 434 - protein, 120 aa, Homo Sapien
MELVLVFLCSLLAPMVLASAAEKEKEMDPFHYDYQTLRIGGLVFAVVLFSVGILLILSRRCKCSFNQKPRAPGDEEAQVENLITANATEPQKQRTEVQPSGGSLWNLRRLLEPLDANVDA

SEQ ID NO: 435 - DNA, 1297 bp, Homo Sapien
ggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaa

SEQ ID NO: 436 - protein, 246 aa, Homo Sapien
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 437 - DNA, 2185 bp, Homo Sapien
gttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtttgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaaca

SEQ ID NO: 438 - protein, 653 aa, Homo Sapien
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 439 - DNA, 434 bp, Homo Sapien
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgc

SEQ ID NO: 440 - protein, 83 aa, Homo Sapien
MRLSVCLLMVSLALCCYQAHALVCPAVASEITVFLFLSDAAVNLQVAKLNPPPEALAAKLEVKHCTDQISFKKRLSLKKSWWK

SEQ ID NO: 441 - DNA, 654 bp, Homo Sapien
gaacatttttagttcccaaggaatgtacatcagccccacggaagctaggccacctctgggatggggttgctggtttaaaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgta

SEQ ID NO: 442 - protein, 117 aa, Homo Sapien
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 443 - DNA, 1332 bp, Homo Sapien
cggccacagctggcatgctctgcctgatcgccatcctgctgtatgtcctcgtccagtacctcgtgaaccccggggtgctccgcacggaccccagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgagtatgtcccccaccctaagcccccgatccccccaaggctgggtggtcagagctgctcatcttacacctctacttgagtatgtccctaaccctgagccccccacgcctggggccagagtctttgtcccccgtgtgcgcatgtgttcagggtcagcctctcccagaagtgagatcatggacaaaaagggcaaatcacaggaagaaattaaatccatgaggacccagcaggcccagcaagaagctgaactcacgccgagacctgcaggagtggtgccaggtgcttgaagtaacaagtttaaaatgttcagagacaatggaatggaatctattaggcaagaacaggacattatgaaataaggacaggtggacttccaaaaacacaagtagaaattctaacaatgaaatatattacaggcaggtcacccactaaccaaacaactgaagcgagagctgtggtcttgcttggtctcacagtgggcacagcggtaggcggtcagtcatgttgctgaacgacggagggtaaactccccagccccaagaaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcatatcttacagtcactgttgtcttgcctgagggttgaattttttttaatgaaagtgcaatgaaaatcactggattaaatcctacggacacagagctgaaaaaaaaaaaaaaaaaaaaaaaaaaaaaaaa

SEQ ID NO: 444 - protein, 142 aa, Homo Sapien
MNTWLLFLPLFPVQVQTLIVVIIGMLVLLLDFLGLVHLGQLLIFHIYLSMSPTLSPRSPQGWVVRAAHLTPLLEYVPNPEPPTPGARVFVPRVRMCSGSASPRSEIMDKKGKSQEEIKSMRTQQAQQEAELTPRPAGVVPGA

SEQ ID NO: 445 - DNA, 687 bp, Homo Sapien
aggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaag

SEQ ID NO: 446 - protein, 180 aa, Homo Sapien
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 447 - DNA, 1484 bp, Homo Sapien
ggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgaaa

SEQ ID NO: 448 - protein, 285 aa, Homo Sapien
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 449 - DNA, 4104 bp, Homo Sapien
cccacgcgtccgcccacgcgtccgcccacgcgtccgcccacgcgtccgcccacgcgtccgcccacgcgtccgcccacgcgtccggtgcaagctcgcgccgcacactgcctggtggagggaaggagcccgggcgcctctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcagcaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattatctttaagcttcaagaaacttgctctgacccctctaagcaaactactaagcatttaaaagagaatctaatttttaaaggtgtagcacctttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 450 - protein, 522 aa, Homo Sapien
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLSNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 451 - DNA, 2623 bp, Homo Sapien
ttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgagggtgggagagaaaattagggggagaaaggacagagagagcaactaccatccatagccagatagattatcttacactgaactgatcaagtactttgaaaatgacttcgaaatttatcttggtgtccttcatacttgctgcactgagtctttcaaccaccttttctctccaactagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattgttgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcactgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatctgcagaaaccattaagcagttacatatttaggtatacacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatatattgcactttaaatttctctcctgatgggtactttaatttgaaatgcactttatggacagttatgtcttataacttgattgaaaatgacaactttttgcacccatgtcacagaatacttgttacgcattgttcaaactgaaggaaatttctaataatcccgaataatgaacatagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatacttttcttctatatagttcagcaatggcctgaatagaagcaaccaggcaccatctcagcaatgttttctcttgtttgtaattatttgctcctttgaaaattaaatcactattaattacattaaaaatcaaattggataaaaaaaaaaaaaaaaaaa

SEQ ID NO: 452 - protein, 477 aa, Homo Sapien [sequence omitted]

SEQ ID NO: 453 - DNA, 1674 bp, Homo Sapien
ggccgcctggaattgtgggagttgtgtctgccactcggctgccggaggccgaaggtccgtgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 454 - protein, 461 aa, Homo Sapien
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 455 - DNA, 1570 bp, Homo Sapien
gccccagggagcagtgggtggttataactcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaa

SEQ ID NO: 456 - protein, 293 aa, Homo Sapien
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 457 - DNA, 1841 bp, Homo Sapien
gcagtcagagacttcccctgcccctcgctgggaaagaacattaggaatgccttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatcctcaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaaaaa

SEQ ID NO: 458 - protein, 280 aa, Homo Sapien [sequence omitted]

SEQ ID NO: 459 - DNA, 1337 bp, Homo Sapien
gttgatggcaaacttcctcaaaggaggggcagagcctgcgcagggcaggagcagctggcccactggcggcccgcaacactccgtctcaccctctgggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaaaaaaaaaaa

SEQ ID NO: 460 - protein, 224 aa, Homo Sapien
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 461 - DNA, 2528 bp, Homo Sapien
aaactcagcacttgccggagtggctcattgttaagacaaagggtgtgcacttcctggccaggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcgaggaggacaaccatctatgcagagccagcgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaaaaaaaaaaaaaaa

SEQ ID NO: 462 - protein, 600 aa, Homo Sapien [sequence omitted]

SEQ ID NO: 463 - DNA, 3226 bp, Homo Sapien
gggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacagtgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccaacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcaaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgcccggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctttttcatgaatgggctatcgctaccatgtgttttgttcatcacaggtgttgccctgcaacgtaaacccaagtgttgggttccctgccacagaagaataaagtaccttattcttctcaaaaaaaaaaaaaaaaaaaaaaaaaaa

SEQ ID NO: 464 - protein, 941 aa, Homo Sapien [sequence omitted]

SEQ ID NO: 465 - DNA, 1587 bp, Homo Sapien
cagccacagacgggtcatgagcgcggtattactgctggccctcctggggttcatcctcccactgccaggagtgcaggcgctgctctgccagtttgggacagttcagcatgtgtggaaggtgtccgacctaccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccaggttgcaacctgctcaatgggacacaggaaattgggcccgtgggtatgactgagaactgcaataggaaagattttctgacctgtcatcgggggaccaccattatgacacacggaaacttggctcaagaacccactgattggaccacatcgaataccgagatgtgcgaggtggggcaggtgtgtcaggagacgctgctgctcatagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttca

SEQ ID NO: 466 - protein, 437 aa, Homo Sapien
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPGCNLLNGTQEIGPVGMTENCNRKDFLTCHRGTTIMTHGNLAQEPTDWTTSNTEMCEVGQVCQETLLLIDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 467 - DNA, 2475 bp, Homo Sapien
gaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgtatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcattgaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaaaaaaaaaaaaaa

SEQ ID NO: 468 - protein, 402 aa, Homo Sapien
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIVSEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 469 - DNA, 1415 bp, Homo Sapien
tggcctccccagcttgccaggcacaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacatgctggctttagaataaaagcaccaactgaaaaaa

SEQ ID NO: 470 - protein, 105 aa, Homo Sapien
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 471 - DNA, 1281 bp, Homo Sapien
agcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaa

SEQ ID NO: 472 - protein, 229 aa, Homo Sapien
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 473 - DNA, 713 bp, Homo Sapien
aatatatcatctatttatcattaatcaataatgtattcttttattccaataacatttgggttttgggattttaattttcaaacacagcagaatgacattttttctgtcactattattattgttggtatgtgaagctatttggagatccaattcaggaagcaacacattggagaatggctactttctatcaagaaataaagagaaccacagtcaacccacacaatcatctttagaagacagtgtgactcctaccaaagctgtcaaaaccacaggcaagggcatagttaaaggacggaatcttgactcaagagggttaattcttggtgctgaagcctggggcaggggtgtaaagaaaaacacttagattcaatgattgtaaatttaaggcaaatacacatattagtattaccttagtgtaatgtatccctgtcatatatacaataaggtgaaattataagtaccctatgcagttggctggacagttctaaattggactttattaatttttaaaatcagtaactgatttatcactggctatgtgcttagatctacaggagatcatataatttgatacaaataaaagaaaagtgttctctccccttacagaattgacattttaaatgcgatacagttagaataggaaatatgacattagaaaggaagaatgacagggagaaaggaaagaagggaaaatgttgccaaggaaaaaaaaa

SEQ ID NO: 474 - protein, 90 aa, Homo Sapien
MTFFLSLLLLLVCEAIWRSNSGSNTLENGYFLSRNKENHSQPTQSSLEDSVTPTKAVKTTGKGIVKGRNLDSRGLILGAEAWGRGVKKNT

SEQ ID NO: 475 - DNA, 1844 bp, Homo Sapien
gacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaaaaaaaaaaaaaaaaaaaaaaaaaaaaaaaaaaaaaaaaaaaaa

SEQ ID NO: 476 - protein, 567 aa, Homo Sapien
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 477 - DNA, 3316 bp, Homo Sapien
ctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatactgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagataaaaaa

SEQ ID NO: 478 - protein, 739 aa, Homo Sapien
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 479 - DNA, 2725 bp, Homo Sapien
ggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaagtcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctgggaaaaaaaaaaaaaaaaaaaaaaaaaa

SEQ ID NO: 480 - protein, 660 aa, Homo Sapien
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 481 - DNA, 1346 bp, Homo Sapien
gaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaaggggggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttaaaaaaaaaaaaaaaaaaaaaaaaaa

SEQ ID NO: 482 - protein, 212 aa, Homo Sapien
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGILMMPS

SEQ ID NO: 483 - DNA, 2498 bp, Homo Sapien
cgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccataaaaaaaa

SEQ ID NO: 484 - protein, 263 aa, Homo Sapien
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 485 - DNA, 1429 bp, Homo Sapien
gctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctga

SEQ ID NO: 486 - protein, 401 aa, Homo Sapien
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 487 - DNA, 1371 bp, Homo Sapien
aactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgtcg

SEQ ID NO: 488 - protein, 215 aa, Homo Sapien
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 489 - DNA, 2476 bp, Homo Sapien
aagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaaggattgaagcaaatactgtaacagttatgttcctttaaataatagagaatataaaatattgtaataatatgtatcataaaatagttgtatgtgagcatttgatggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 490 - protein, 536 aa, Homo Sapien
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 491 - DNA, 1475 bp, Homo Sapien
gagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaata

SEQ ID NO: 492 - protein, 230 aa, Homo Sapien
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 493 - DNA, 610 bp, Homo Sapien
gcactgctgctgtcccatcagctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtaaaa

SEQ ID NO: 494 - protein, 119 aa, Homo Sapien
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 495 - DNA, 771 bp, Homo Sapien
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaaaa

SEQ ID NO: 496 - protein, 110 aa, Homo Sapien
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 497 - DNA, 2089 bp, Homo Sapien
tgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccagggaggaagaggaagatgagcaggaggccagcgaggagaaggccggtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctctcacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacgaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacatgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaacgcaagcactgcaataccataacagtcaaactgattatagagaaggctactaagtgactcatgggcgaggagcatagacagtgtggagacattgggcaaggggagaattcacatcctgggtgggacagagcaggacgatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaaaaaaaaaa

SEQ ID NO: 498 - protein, 444 aa, Homo Sapien [sequence omitted]

SEQ ID NO: 499 - DNA, 693 bp, Homo Sapien
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaaaaaaaaaaaaaaaaaaaaaaaaaaaaaaaaaaaaaaaaaaaaaaaaaa

SEQ ID NO: 500 - protein, 93 aa, Homo Sapien [sequence omitted]

SEQ ID NO: 501 - DNA, 1883 bp, Homo Sapien
caggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggtagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccacaaaaaaaaaaaaaaaaaaaaaaaaaaaaaaaaaaaaaaaaaaaaaaaaaaaaaaaaaaaaaaaaaaaaaaaaa

SEQ ID NO: 502 - protein, 406 aa, Homo Sapien [sequence omitted]

SEQ ID NO: 503 - DNA, 689 bp, Homo Sapien
tgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 504 - protein, 163 aa, Homo Sapien
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 505 - DNA, 1204 bp, Homo Sapien
gttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaaaaaaaaaaaaaaaaaaaaaaaaaaaaaaaaaa

SEQ ID NO: 506 - protein, 250 aa, Homo Sapien
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 507 - DNA, 636 bp, Homo Sapien
ctgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggcaaaaaaaaaaaaaaaaaaa

SEQ ID NO: 508 - protein, 151 aa, Homo Sapien
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 509 - DNA, 1281 bp, Homo Sapien
gcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatcttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactcc

SEQ ID NO: 510 - protein, 208 aa, Homo Sapien
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 511 - DNA, 2668 bp, Homo Sapien
gactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggaaaaaaaaaaaaaaaaaaaaaaaaaaaaaaaaaaaaaaaaaaaaaaaaaaaaaaaaaaaaaaaaaaaaaaaaa

SEQ ID NO: 512 - protein, 716 aa, Homo Sapien
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 513 - DNA, 957 bp, Homo Sapien
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 514 - protein, 247 aa, Homo Sapien
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 515 - DNA, 1942 bp, Homo Sapien
cccacgcgtccgcccacgcgtccgggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgccactcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacagtaagtacacaaaagtacactattatatatcaaatgtatttctataatccctccattagagagcttatataagtgttttctatagatgcagattaaaaatgctgtgttgtcaaccgtcaaaaaaaaaaaaaaaaaaaaaaaaaaa

SEQ ID NO: 516 - protein, 325 aa, Homo Sapien
MPSSTAMAVGALSSSLLVTCCLMVALCSPSIPLEKLAQAPEQPGQEKREHATRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 517 - DNA, 1419 bp, Homo Sapien
ggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgagatctctacagaatcagaagatgttcctcagctctcaggtgaaactgcgatagaaaaacccgaagagtttggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcaggaaaaaa

SEQ ID NO: 518 - protein, 350 aa, Homo Sapien [sequence omitted]

SEQ ID NO: 519 - DNA, 1630 bp, Homo Sapien
cggctcgagtgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcaa

SEQ ID NO: 520 - protein, 394 aa, Homo Sapien
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 521 - DNA, 963 bp, Homo Sapien
ctatgaagaagcttcctggaaaacaataagcaaaggaaaacaaatgtgtcccatctcacatggttctaccctactaaagacaggaagatcataaactgacagatactgaaattgtaagagttggaaactacattttgcaaagtcattgaactctgagctcagttgcagtactcgggaagccatgcaggatgaagatggatacatcaccttaaatattaaaactcggaaaccagctctcgtctccgttggccctgcatcctcctcctggtggcgtgtgatggctttgattctgctgatcctgtgcgtggggatggttgtcgggctggtggctctggggatttggtctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaaaaaaaaaaaa

SEQ ID NO: 522 - protein, 229 aa, Homo Sapien
MQDEDGYITLNIKTRKPALVSVGPASSSWWRVMALILLILCVGMVVGLVALGIWSVMQRNYLQDENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 523 - DNA, 1197 bp, Homo Sapien
cagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaaaaaaaaaaaaaaaaaaa

SEQ ID NO: 524 - protein, 317 aa, Homo Sapien
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 525 - DNA, 535 bp, Homo Sapien
agtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccaga

SEQ ID NO: 526 - protein, 85 aa, Homo Sapien
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 527 - DNA, 2387 bp, Homo Sapien
cgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttaaaaaaaaa

SEQ ID NO: 528 - protein, 487 aa, Homo Sapien
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 529 - DNA, 1777 bp, Homo Sapien
ggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggtttta

SEQ ID NO: 530 - protein, 269 aa, Homo Sapien
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 531 - DNA, 1150 bp, Homo Sapien
gtgacactatagaagagctatgacgtcgcatgcacgcgtacgtaagctcggaattcggctcgaggctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcaaaaaaaaa

SEQ ID NO: 532 - protein, 269 aa, Homo Sapien [sequence omitted]

SEQ ID NO: 533 - DNA, 496 bp, Homo Sapien
  unsure 396: unknown base
tctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcggcatctacaaggacaacaacaaaagcagcatacattgtatggatttatctcaacgctattgtttaatggctgtgtttaatgtgatctatctggaaaatgaggactccgaataaaaagctattactawttnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 534 - protein, 116 aa, Homo Sapien [sequence omitted]

SEQ ID NO: 535 - DNA, 2379 bp, Homo Sapien
gctgagcgtgtgcgcggtacggggctctcctgccttctgggctccaacgcagctctgtggctgaactgggtgctcatcacgggaactgctgggctatggaatacagatgtggcagctcaggtagccccaaattgcctggaagaatacatcatgtttttcgataagaagaaattgtaggatccagttttttttttaaccgccccctccccaccccccaaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttggtggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataggtaaaaaaaaaaa

SEQ ID NO: 536 - protein, 513 aa, Homo Sapien
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEV

SEQ ID NO: 537 - DNA, 3554 bp, Homo Sapien
gggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 538 - protein, 310 aa, Homo Sapien
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 539 - DNA, 2570 bp, Homo Sapien
ccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcatattcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgggggaaaaaaaaaaaaaaaaaaaaaaaaaaaaaaaaaaaaaaaa

SEQ ID NO: 540 - protein, 273 aa, Homo Sapien
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 541 - DNA, 3824 bp, Homo Sapien
ggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagcccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaa

SEQ ID NO: 542 - protein, 571 aa, Homo Sapien
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 543 - DNA, 3721 bp, Homo Sapien
tgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggtttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctatgacctccagctgaccatgcatgccacgtggctggctgggtcctctgccctctttggagtttgcctcccccagccccctccccatcaataaaactctgtttacaaccaaaaaaaaaaaaaaaaaaaaaaaaaaaa

SEQ ID NO: 544 - protein, 888 aa, Homo Sapien
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGGRGGGGGGGAGVPPEALLAPLMQNGWAKATLLQGGPHDLDSGLLPTPEQTPLPQKRLPTPHPHPHALGPRAWDHGHPLLPASASSSLLLLAPARAPEQPPAPGEPTPDGRLYAARPGRASHGDFPLTPHASPDRRRVVSAPTGPLDPASAADGLPRPWSPPPTGSLRRPLGPHAPPAATLRRTHTFNSGEARPGDRHRGCHARPGTDLAHLLPYGGADRTAPPVP

SEQ ID NO: 545 - DNA, 1571 bp, Homo Sapien; identical to SEQ ID NO: 97

SEQ ID NO: 546 - protein, 261 aa, Homo Sapien
MRQFPKTSFDISPEMSFSIYSLQVPAVPGLTCWALTAEPGWGQNKGATTCATNSHSDSELRPEIFSSREAWQFFLLLWSPDFRPKMKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLSHAHMTCHCGEEAMKKYSQILSHFEKLEPQAAVVKALGELDILLQWMEETE

SEQ ID NO: 547 - DNA, 2014 bp, Homo Sapien
agcaactcaagttcatcattgtcctgagagagaggagcagcgcggttctcggccgggacagcagaacgccaggggaccctcacctgggcgcgccggggcacgggctttgattgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaaatgtttggcactttgctactttattgcttctttctggcgacagttccagcactcgccgagaccggcggagaaaggcagctgagcccggagaagagcgaaatatggggacccgggctaaaagcagacgtcgtccttcccgcccgctatttctatattcaggcagtggatacatcagggaataaattcacatcttctccaggcgaaaaggtcttccaggtgaaagtctcagcaccagaggagcaattcactagagttggagtccaggttttagaccgaaaagatgggtccttcatagtaagatacagaatgtatgcaagctacaaaaatctgaaggtggaaattaaattccaagggcaacatgtggccaaatccccatatattttaaaagggccggtttaccatgagaactgtgactgtcctctgcaagatagtgcagcctggctacgggagatgaactgccctgaaaccattgctcagattcagagagatctggcacatttccctgctgtggatccagaaaagattgcagtagaaatcccaaaaagatttggacagaggcagagcctatgtcactacaccttaaaggataacaaggtttatatcaagactcatggtgaacatgtaggttttagaattttcatggatgccatactactttctttgactagaaaggtgaagatgccagatgtggagctctttgttaatttgggagactggcctttggaaaaaaagaaatccaattcaaacatccatccgatcttttcctggtgtggctccacagattccaaggatatcgtgatgcctacgtacgatttgactgattctgttctggaaaccatgggccgggtaagtctggatatgatgtccgtgcaagctaacacgggtcctccctgggaaagcaaaaattccactgccgtctggagagggcgagacagccgcaaagagagactcgagctggttaaactcagtagaaaacacccagaactcatagacgctgctttcaccaactttttcttctttaaacacgatgaaaacctgtatggtcccattgtgaaacatatttcattttttgatttcttcaagcataagtatcaaataaatatcgatggcactgtagcagcttatcgcctgccatatttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaaggaaaaaaa

SEQ ID NO: 548 - protein, 502 aa, Homo Sapien
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 549 - DNA, 1088 bp, Homo Sapien
gggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtttaaaaaaaaaaaaaaaaaaaaaaaaaaaaaaaaaaaaaaa

SEQ ID NO: 550 - protein, 198 aa, Homo Sapien
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

What is claimed is:

1. An isolated polypeptide comprising:
   (a) the amino acid sequence of the polypeptide of SEQ ID NO:398;
   (b) the amino acid sequence of the polypeptide of SEQ ID NO:398, lacking its associated signal peptide; or
   (c) the amino acid sequence of the polypeptide encoded by the full-length coding sequence of the cDNA deposited under ATCC accession number 203002.

2. The isolated polypeptide of claim 1 comprising the amino acid sequence of the polypeptide of SEQ ID NO:398.

3. The isolated polypeptide of claim 1 comprising the amino acid sequence of the polypeptide of SEQ ID NO:398, lacking its associated signal peptide.

4. The isolated polypeptide of claim 1 comprising the amino acid sequence of the polypeptide encoded by the full-length coding sequence of the cDNA deposited under ATCC accession number 203002.

5. A chimeric polypeptide comprising a polypeptide according to claim 1 fused to a heterologous polypeptide.

6. The chimeric polypeptide of claim 5, wherein said heterologous polypeptide is an epitope tag or an Fc region of an immunoglobulin.

* * * * *